US011464217B2

(12) United States Patent
Alessandri-Haber et al.

(10) Patent No.: US 11,464,217 B2
(45) Date of Patent: Oct. 11, 2022

(54) RODENTS HAVING GENETICALLY MODIFIED SODIUM CHANNELS AND METHODS OF USE THEREOF

(71) Applicant: Regeneron Pharmaceuticals, Inc., Tarrytown, NY (US)

(72) Inventors: Nicole Alessandri-Haber, Rye Brook, NY (US); Andrew J. Murphy, Croton-on-Hudson, NY (US); Lynn Macdonald, Harrison, NY (US)

(73) Assignee: Regeneron Pharmaceuticals, Inc., Tarrytown, NY (US)

( * ) Notice: Subject to any disclaimer, the term of this patent is extended or adjusted under 35 U.S.C. 154(b) by 206 days.

(21) Appl. No.: 16/797,280

(22) Filed: Feb. 21, 2020

(65) Prior Publication Data

US 2020/0267950 A1   Aug. 27, 2020

Related U.S. Application Data

(60) Provisional application No. 62/808,957, filed on Feb. 22, 2019.

(51) Int. Cl.
*A01K 67/027* (2006.01)
*C12N 15/85* (2006.01)
*C07K 14/705* (2006.01)

(52) U.S. Cl.
CPC ........ *A01K 67/0278* (2013.01); *C07K 14/705* (2013.01); *C12N 15/8509* (2013.01); *A01K 2207/15* (2013.01); *A01K 2217/052* (2013.01); *A01K 2217/072* (2013.01); *A01K 2227/105* (2013.01)

(58) Field of Classification Search
CPC ............ A01K 67/0278; A01K 2207/15; A01K 2217/052; A01K 2217/072; A01K 2227/105; C07K 14/705; C12N 15/8509
USPC ................. 800/18; 435/320.1, 325
See application file for complete search history.

(56) References Cited

U.S. PATENT DOCUMENTS

| | | |
|---|---|---|
| 6,586,251 B2 | 7/2003 | Economides et al. |
| 7,294,754 B2 | 11/2007 | Poueymirou et al. |
| 7,576,259 B2 | 8/2009 | Poueymirou et al. |
| 7,659,442 B2 | 2/2010 | Poueymirou et al. |
| 8,502,018 B2 | 8/2013 | Murphy et al. |
| 8,642,835 B2 | 2/2014 | MacDonald et al. |
| 8,687,940 B2 | 4/2014 | Park et al. |
| 8,697,940 B2 | 4/2014 | Macdonald et al. |
| 8,791,323 B2 | 7/2014 | Murphy et al. |
| 8,871,996 B2 | 10/2014 | Macdonald et al. |
| 9,006,511 B2 | 4/2015 | Macdonald et al. |
| 9,012,717 B2 | 4/2015 | Macdonald et al. |
| 9,029,628 B2 | 5/2015 | Macdonald et al. |
| 9,035,128 B2 | 5/2015 | Macdonald et al. |
| 9,066,502 B2 | 6/2015 | Macdonald et al. |
| 9,150,662 B2 | 10/2015 | Macdonald et al. |
| 9,163,092 B2 | 10/2015 | Macdonald et al. |
| 9,206,261 B2 | 12/2015 | Macdonald et al. |
| 9,206,262 B2 | 12/2015 | Macdonald et al. |
| 9,206,263 B2 | 12/2015 | Macdonald et al. |
| 9,226,484 B2 | 1/2016 | Macdonald et al. |
| 9,334,333 B2 | 5/2016 | Macdonald et al. |
| 9,394,373 B2 | 7/2016 | Macdonald et al. |
| 9,399,683 B2 | 7/2016 | Macdonald et al. |
| 9,540,452 B2 | 1/2017 | Macdonald et al. |
| 9,796,788 B2 | 10/2017 | Mcwhirter et al. |
| 9,932,408 B2 | 4/2018 | Macdonald et al. |
| 9,944,716 B2 | 4/2018 | Macdonald et al. |
| 9,969,814 B2 | 5/2018 | McWhirter et al. |
| 2008/0078000 A1 | 3/2008 | Poueymirou et al. |
| 2011/0154512 A1 | 6/2011 | MacDonald et al. |
| 2011/0195454 A1 | 8/2011 | McWhirter et al. |
| 2012/0021409 A1 | 1/2012 | McWhirter et al. |
| 2012/0192300 A1 | 7/2012 | Babb et al. |
| 2013/0045492 A1 | 2/2013 | Babb et al. |
| 2013/0185821 A1 | 7/2013 | Babb et al. |
| 2013/0302836 A1 | 11/2013 | McWhirter et al. |
| 2014/0235933 A1 | 8/2014 | Lee et al. |
| 2014/0310828 A1 | 10/2014 | Lee et al. |
| 2016/0007579 A1 | 1/2016 | Kyratsous et al. |
| 2018/0125043 A1 | 5/2018 | Guo et al. |
| 2019/0290783 A1 | 9/2019 | Voronina et al. |
| 2020/0154684 A1 | 5/2020 | Mujica et al. |

FOREIGN PATENT DOCUMENTS

| | | |
|---|---|---|
| WO | 2011/097603 A1 | 8/2011 |
| WO | 2012/148873 A2 | 11/2012 |
| WO | 2013/134263 A1 | 9/2013 |
| WO | 2013/184761 A1 | 12/2013 |
| WO | 2014/159595 A2 | 10/2014 |

(Continued)

OTHER PUBLICATIONS

Dave et al. (2014) Neurobiol. Dis., vol. 70, 190-203.*
Mullins et al. (1996) J. Clin. Invest., vol. 98(11), pp. S37-S40.*
Gingras et al. (2014) PLoS One, vol. 9(9), e105895, doi:10.1371/journal.pone.0105895, pp. 1-14.*
Kearney et al. (2001) Neuroscience, vol. 102(2), p. 307-317.*
Yamagata et al. (2017) Biochem. Biophys. Res. Comm., vol. 491, 1070-1076.*
Gazina et al. (2015) Human Molecular Genetics, vol. 24(5), 1457-1468.*
Bissonnette R. et al., "Based on Molecular Profiling of Gene Expression, Palmoplantar PUstulosis and Palmoplantar Pustular Psoriasis are Highly Related Diseases that Appear to be Distinct from Psoriasis Vulgaris", PLoS ONE 11(5):e0155215 (May 2016).

(Continued)

*Primary Examiner* — Anne Marie S Wehbe
(74) *Attorney, Agent, or Firm* — Scully, Scott, Murphy & Presser, P.C.; Elysa Goldberg

(57) ABSTRACT

Disclosed herein are rodents (such as mice and rats) genetically modified at an endogenous Scn9a locus to comprise an exogenous Scn nucleotide sequence such as the coding sequence of a human SCN2A gene. Also disclosed are methods and compositions useful for making such rodents, and methods of using such rodents for generating anti-NaV1.7 antibodies.

26 Claims, 69 Drawing Sheets

Specification includes a Sequence Listing.

(56) References Cited

FOREIGN PATENT DOCUMENTS

| WO | 2014/160179 A1 | 10/2014 |
|---|---|---|
| WO | 2014/160202 A1 | 10/2014 |
| WO | 2017/143062 A1 | 8/2017 |
| WO | 2017/214089 A1 | 12/2017 |
| WO | 2019/006034 A1 | 1/2019 |
| WO | 2019/113065 A1 | 6/2019 |

OTHER PUBLICATIONS

Boutet M.A. et al., "Distinct Expression of Interleukin (IL)-36α, β and γ, Their Antagonist IL-36Ra and IL-38 in Psoriasis, Rheumatoid Athritis and Crohn's Disease", Clinical and Experimental Immunology 184:159-173 (2016).

D'Erme A.M. et al., "IL-36γ (IL-1F9) is a Biomarker for Psoriasis Skin Lesions", Journal of Investigative Dermatology 135:1025-1032 (2015).

Emery E.C. et al., "Nav1.7 and Other Voltage-Gated Sodium Channels as Drug Targets for Pain Relief", Expert Opinion on Therapeutic Targets 20(8):975-983 (2016).

Gingras J. et al., "Global Nav1.7 Knockout Mice Recapitulate the Phenotype of Human Congenital Indifference to Pain", PLoS ONE 9(9):e105895 (Sep. 2014).

Harusato A. et al., "IL-36γ Signaling Controls the Induced Regulatory T Cell-Th9 Cell Balance Via NFKB Activation and STAT Transcription Factors", Muscosal Immunol. 10(6):1455-1467 (Nov. 2017).

Jakobovits A. et al., "Production of Antigen-Specific Human Antibodies from Mice Engineered with Human Heavy and Light Chain YACsa", Annals New York Academy of Sciences 764:525-535 (1995).

Johnston A. et al., "IL-1 and IL-36 are Dominant Cytokines in Generalized Pustular Psoriasis", J Allergy Clin Immunol 140(1):109-120 (Jul. 2017).

Mahil S.K. et al., "An Analysis of IL-36 Signature Genes and Individuals with IL1rL2 Knockout Mutations Validates IL-36 as a Psoriasis Therapeutic Target", Science Translational Medicine 9(411):eaan2514 (Oct. 11, 2017).

Marrakchi S. et al., "Interleukin-36-Receptor Antagonist Deficiency and Generalized Pustular Psoriasis", The New England Journal of Medicine 365(7):620-628 (Aug. 18, 2011).

Margulies D.H. "Induction of Immune Responses", Current Protocols in Immunology 89(1):2.0.1-2.0.3 (2010).

Medina-Contreras O. et al., "Cutting Edge: IL-36 Receptor Promotes Resolution of Intestinal Damage", The Journal of Immunology 196:34-38 (Feb. 2016).

Mendez M.J. Et al., "Functional Transplant of Megabase Human Immunoglobulin Loci Recapitulates Human Antibody Response in Mice", Nature Genetics 15:146-156 (Feb. 1997).

Michael S.K. et al., "Efficient Gene-Specific Expression of Cre Recombinase in the Mouse Embryo by Targeted Insertion of a Novel IRES-Cre Cassette into Endogenous Loci", Mechanisms of Development 85:35-47 (1999).

Nishida A. et al., "Increased Expression of Interleukin-36, a Member of the Interleukin-1 Cytokine Family, in Inflammatory Bowel Disease", Inflamm Bowel Dis 22(2):303-314 (Feb. 2016).

Russell Se et al., "IL-36α Expression is Elevated in Ulcerative Colitis and Promotes Colonic Inflammation", Nature 9(5):1193-1204 (Sep. 2016).

Shields S.D. et al., "Insensitivity to Pain Upon Adult-Onset Deletion of Nav1.7 or its Blockade With Selective Inhibitors", The Journal of Neuroscience 38(47):10180-10201 (Nov. 21, 2018).

Tong C. et al., "Generating Gene Knockout Rats by Homologous Recombinations in Embryonic Stem Cells", Nat Protoc. 6(6):doi:10.1038/nprot.2011.338 (Jun. 2011).

Tong C. et al., "Production of p53 Gene Knockout Rats by Homologous Recombination in Embryonic Stem Cells", Nature 467:211-215 (Sep. 9, 2010).

Tortola L. et al., "Psoriasiform Dermatitis is Driven by IL-36-Mediated DC-Keratinocyte Crosstalk", The Journal of Clinical Investigation 122(11):3965-3976 (Nov. 2012).

Towne Je et al., "IL-36 is Psoriasis", Current Opinion in Pharmacology 12:486-490 (2012).

Valenzuela D.M. et al., "High-Throughput Engineering of the Mouse Genome Coupled With High-Resolution Expression Analysis", Nature Biotechnology 21(6):652-659 (Jun. 2003).

Van Der Heyde H.C. et al., "Analysis of Antigen-Specific Antibodies and Their Isotypes in Experimental Malaria", Cytometry Part A 71A:242-250 (2007).

Wallace H. et al., "Pre-Selection of Integration Sites Imparts Repeatable Transgene Expression", Nucleic Acids Research 28(6):1455-1464 (2000).

Zambrowicz B.P. et al., "Disruption of Overlapping Transcripts in the ROSA βgeo 26 Gene Trap Strain Leads to Widespread Expression of β-Galactosidase in Mouse Embryos and Hematopoietic Cells", Proc. Natl. Acad. Sci. USA 94:3789-3794 (Apr. 1997).

Breeding Strategies for Maintaining Colonies of Laboratory Mice, A Jackson Laboratory Resource Manual, The Jackson Laboratory (2007).

NCBI Reference Sequence No. NP_001092768.1 (7 pages) (May 7, 2020).

NCBI Reference Sequence No. NP_001104257.2 (3 pages) (May 14, 2018).

NCBI Reference Sequence No. NP_001137581.1 (2 pages) (May 29, 2018).

NCBI Reference Sequence No. NP_001280210.1 (2 pages) (Jun. 26, 2018).

NCBI Reference Sequence No. NP_001280211.1 (2 pages) (Dec. 24, 2015).

UniProtKB/Swiss-Prot No. P04775.1 (11 pages) (Apr. 22, 2020).
UniProtKB/Swiss-Prot No. P35498.2 (45 pages) (Apr. 22, 2020).
UniProtKB/Swiss-Prot No. P35499.4 (24 pages) (Apr. 22, 2020).
UniProtKB/Swiss-Prot No. Q9NY46.2 (11 pages) (Apr. 22, 2020).
UniProtKB/Swiss-Prot No. Q9UI33.2 (10 pages) (Apr. 22, 2020).
UniProtKB/Swiss-Prot No. Q9UQD0.1 (16 pages) (Apr. 22, 2020).
UniProtKB/Swiss-Prot No. Q9Y5Y9.2 (8 pages) (Apr. 22, 2020).
UniProtKB/Swiss-Prot No. Q14524.2 (54 pages) (Apr. 22, 2020).
UniProtKB/Swiss-Prot No. Q15858.3 (20 pages) (Apr. 22, 2020).
UniProtKB/Swiss-Prot No. Q28644.1 (6 pages) (Nov. 13, 2019).
UniProtKB/Swiss-Prot No. Q62205.2 (7 pages) (Apr. 22, 2020).
UniProtKB/Swiss-Prot No. Q99250.3 (30 pages) (Apr. 22, 2020).
UniProtKB/Swiss-Prot No. O08562.1 (7 pages) (Apr. 22, 2020).
GenBank No. ETE69867.1 (3 pages) (Dec. 11, 2013).
GenBank No. DAA65084.1 (2 pages) (Jul. 2, 2016).

NCBI Reference Sequence No. XP_001100368.1 (2 pages) (Apr. 26, 2019).

NCBI Reference Sequence No. XP_001496473.1 (2 pages) (Nov. 20, 2015).

NCBI Reference Sequence No. XP_003820970.1 (2 pages) (May 1, 2018).

NCBI Reference Sequence No. XP_004004679.1 (2 pages) (Dec. 17, 2015).

NCBI Reference Sequence No. XP_004267302.1 (2 pages) (Apr. 15, 2020).

NCBI Reference Sequence No. XP_004283641.1 (2 pages) (Apr. 15, 2020).

NCBI Reference Sequence No. XP_007056690.1 (2 pages) (Jan. 23, 2019).

NCBI Reference Sequence No. XP_008256915.1 (2 pages) (Jun. 23, 2016).

NCBI Reference Sequence No. XP_008582720.1 (2 pages) (Jul. 22, 2014).

NCBI Reference Sequence No. XP_008588371.1 (2 pages) (Jul. 22, 2014).

NCBI Reference Sequence No. XP_010980763.1 (2 pages) (Jan. 7, 2015).

NCBI Reference Sequence No. XP_010980767.1 (2 pages) (Jan. 7, 2015).

NCBI Reference Sequence No. XP_014588001.1 (2 pages) (Jan. 23, 2018).

(56) References Cited

OTHER PUBLICATIONS

NCBI Reference Sequence No. XP_014965766.1 (2 pages) (Dec. 21, 2015).
Bang S. et al., "Differential Inhibition of Nav1.7 and Neuropathic Pain by Hybridoma-Produced and Recombinant Monoclonal Antibodies that Target Nav1.7", Neuroscience Bulletin 34(1):22-41 (Feb. 2018).
Hrabovska A. et al., "A Novel System for the Efficient Generation of Antibodies Following Immunization of Unique Knockout Mouse Strains", PLoS ONE 9:e12892 (Sep. 23, 2010).
Yu F H et al., "Overview of the Voltage-Gated Sodium Channel Family", Genome Biology 4(3):207 (Jan. 1, 2003).
International Search Report and Written Opinion dated May 15, 2020 received in International Application No. PCT/US2020/019171.
NCBI Reference Sequence No. XP_016804947.1 (2 pages) (Jun. 2, 2016).
NCBI Reference Sequence No. XP_022270547.1 (2 pages) (Sep. 5, 2017).
NCBI Reference Sequence No. XP_014948870.1 (2 pages) (Dec. 17, 2015).

\* cited by examiner

|           |     |                                                              |     |
|-----------|-----|--------------------------------------------------------------|-----|
|           |     | cytoplasmic                                                  |     |
| mScn9a    | 1   | MAMLPPPGPQSFVHFTKQSLALIEQRISEEKAKGHKDEKKD-DEEEGPKPSSDLEAGK    | 57  |
| hSCN2A    | 1   | MAQSVLVPPGPDSFRFFTRESLAAIEQRIAEEKAKRPQERKDEDDENGPKPNSDLEAGK   | 60  |
|           |     |  *  *:* *   : *:**::** :*: :. .**.*****     |     |
|           |     | cytoplasmic                                                  |     |
| mScn9a    | 58  | QLPFIYGDIPPGMVSEPLEDLDPYYADKKTFIVLNKGKAIFRFNATPALYMLSPFSPLRR  | 117 |
| hSCN2A    | 61  | SLPFIYGDIPPEMVSVPLEDLDPYYINKKTFIVLNKGKAISRFSATPALYILTPFNPIRK  | 120 |
|           |     | .********.*.*******.*********..******:*.**..*:  |     |
|           |     |                    TM1          extracellular      TM2      |     |
| mScn9a    | 118 | ISIKILVHSLFSMLIMCTILTNCIFMTMSNPPDWTKNVEYTFTGIYTFESLIKILARGFC  | 177 |
| hSCN2A    | 121 | LAIKILVHSLFNMLIMCTILTNCVFMTMSNPPDWTKNVEYTFTGIYTFESLIKILARGFC  | 180 |
|           |     | :********:* *********:********************************  |     |
|           |     | cytoplasmic       TM3            extracellular      TM4      cytoplasmic |     |
| mScn9a    | 178 | VGEFTFLRDPWNWLDFVVIVFAYLTEFVNLGNVSALRTFRVLRALKTISVIPGLKTIVGA  | 237 |
| hSCN2A    | 181 | LEDFTFLRDPWNWLDFTVITFAYVTEFVDLGNVSALRTFRVLRALKTISVIPGLKTIVGA  | 240 |
|           |     | : ****.***..*::*************************** |     |
|           |     |                              TM5                             |     |
| mScn9a    | 238 | LIQSVKKLSDVMILTVFCLSVFALIGLQLFMGNLKHKCFRKDLEQ----NETL        | 286 |
| hSCN2A    | 241 | LIQSVKKLSDVMILTVFCLSVFALIGLQLFMGNLRNKCLQWPPDNSSFEINITSFFNNSL | 300 |
|           |     | ********************************:: : : :  :: *          |     |
|           |     |                extracellular                                 |     |
| mScn9a    | 287 | ESIMSTAESEE-----ELKRYFYLEGSKDALLCGFSTDSGQCPEGYECVTAGRNP       | 337 |
| hSCN2A    | 301 | DGNGTTFNRTVSIFNWDEYIEDKSHFYFLEGQNDALLCGNSSDAGQCPEGYICVKAGRNP  | 360 |
|           |     | :.  :: .:* :  :   *: * :.: ****. ..*.***** .*****   |     |
|           |     |    pore-forming        extracellular     TM6                 |     |
| mScn9a    | 338 | DYGYTSFDTFGWAFLALFRLMTQDYWENLYQQTLRAAGKTYMIFFVVVIFLGSFYLINLI  | 397 |
| hSCN2A    | 361 | NYGYTSFDTFSWAFLSLFRLMTQDFWENLYQLTLRAAGKTYMIFFVLVIFLGSFYLINLI  | 420 |
|           |     | :*******.:***:**** *:***********:*.************ |     |
|           |     |                  cytoplasmic                                 |     |
| mScn9a    | 398 | LAVVAMAYEEQNQANIEEAKQKELEFQQMLDRLKKEQEEAEAIAAAAEYTS---LGRSRI | 455 |
| hSCN2A    | 421 | LAVVAMAYEEQNQATLEEAEQKEAEFQQMLEQLKKQQEEAQAAAAAASAESRDFSGAGGI | 480 |
|           |     | :                :    *::  ::*:************:::  |     |
|           |     |                  cytoplasmic                                 |     |
| mScn9a    | 456 | MGLSESSSETSRLSSKSAKERRNRRKKKKQKLSSGEEKGDDEKLSKSGSEESIRKKSFHL  | 515 |
| hSCN2A    | 481 | GVFSESSSVASKLSSKSEKELKNRRKKKKQKEQSGEEEKND-RVRKSESEDSIRRKGFRF  | 539 |
|           |     |    ***. : ***:*:*:****** .**:::    *:*.:*:* *   |     |

FIG. 1D

```
mScn9a   516  GVEGHHRAREKRLSTPNQSPLSIRGSLFSARRSSRTSLFSFKGRDLGSETEFADDEHS              575
hSCN2A   540  SLEGSRLTYEKRFSSPHQSLLSIRGSLFSPRRNSRASLFSFRGRAKDIGSENDFADDEHS           599
                *  *****    *  *  ****** * *  ** * *    ******* mScn9a   576  IFGDNESRRGSLFVPHRPRERRSSNISQASRSP----PVLPVNGKMHSAVDCNGVVSLVDG         632
hSCN2A   600  TFEDNDSRRDSLFVPHRHGERRHSNVSQASRASRVLPTLPMNGKMHSAVDCNGVVSLVGG          659
              *** * * *** *  * **         *  ************** * mScn9a   633  PSALMLPNGQLLPEVIIDKATSDDSGTTNQMRKKRLSSSYFLSEDMLNDPHLRQRAMSRA          692
hSCN2A   660  PSTLTS-AGQLLPEG-------TTTETEIRKRRSSSYHVSMDLLEDPTSRQRAMSIA             708
                 ****         * *  ****  * * **  ***  * mScn9a   693  SILTNTVEELEESRQKCPPWWYRFAHTFLIWNCSPYWIKFKKFIYFIVMDPFVDLAITIC          752
hSCN2A   709  SILTNTMEELEESRQKCPPFCWYKFANMCLIWDCCKFWLKVKHLVNLVVMDPFVDLAITIC         768
              ****** ************  *** *   *** *  * * *   * ******** *****
                                                                    TM7 mScn9a   753  IVLNTLFMAMEHHPMTDEFKNVLAVGNLVFTGIFAAEMVLKLIAMDPYEYFQVGWNIFDS          812
hSCN2A   769  IVLNTLFMAMEHYPMTEQFSSVLSVGNLVFTGIFTAEMFLKLIAMDPYYYFQEGWNIFDG          828
              ************ ***  *  ** ********* *** *********** **  *****
                              TM8 mScn9a   813  LIVTLSLVELFLADVEGLSVLRSFRLLRVFKLAKSWPTLNMLIKIIGNSVQALGNLTLVL          872
hSCN2A   829  FIVSLSLMELGLANVEGLSVLRSFRLLRVFKLAKSWPTLNMLIKIIGNSVQALGNLTLVL          888
               ** *** **  * ************************************************
                   TM9                        TM10 mScn9a   873  AIIVFIFAVVGMQLFGKSYKECVCKINENCKLPRWHMNDFFHSFLIVFRVLCGEWIETMW          932
hSCN2A   889  AIIVFIFAVVGMQLFGKSYKECVCKISNDCELPRWHMHDFFHSFLIVFRVLCGEWIETMW          948
              ************************** *  * ***** *********************
                                                            Pore-forming
                   TM11 mScn9a   933  DCMEVAGQTMCLIVYMMVIGNLVFLALILFLSSFSSDNLTAIEEDTDANNLQIAVA               992
hSCN2A   949  DCMEVAGQTMCLTVFMMVIGNLVFLALILFLSSFSSDNLAATDDDNEMNNLQIAVG              1008
              ************ * ************************   *  *  *******
                   TM12 mScn9a   993  RIKRGINYVKQTLREFILKSFSKKPKGSKDTKRTADPNNKRENYISNRTLAEISKDHNFL         1052
hSCN2A  1009  RMQKGIDFVKRKIREFIQKAFVRKQKALDEIKPLEDLNNKKDSCISNHTTIEIGKDLNYL         1068
               * *** *** * ****  *     *    *   * *     ** *  *  *  **  *
```

FIG. 1D (cont'd)

```
mScn9a   1053  KE-KDKISGFSSSLDKSFMDENDYQSFIHNPSLTTVTVPIAPGESDLENMNTEELSSDSDS  1111
hSCN2A   1069  KDGNGTTSGIGSSVEKYVVDESDYMSFINNPSLTTVTVPIAVGESDFENLNTEEFSSESDM  1128
                                                    cytoplasmic
              *  *    *        **** ***** * ** *  **  * mScn9a   1112  DYSKERRNRSSSSECSTVDNPLPGE-EEAEAEPINADEPEACFTDGCVRRFPCCQVNIDS  1170
hSCN2A   1129  EESKEKLNATSSSEGSTVDIGAPAEGEQPEVEPESLEPEACFTEDCVRKFPKCCQISIEE  1188
                                                    cytoplasmic
                 *     ***** *      *  *       **** *     * extracellular    TM14
mScn9a   1171  GKGKVVWTIRKTCYRIVEHSWFESPIVIMILLSSGALAFEDIYIEKKKTIKILEYADKI   1230
hSCN2A   1189  GKGKLWWNLRKTCYKIVEHNWFETFIVFMILLSSGALAFEDIYIEQRKTIKTMLEYADKV  1248
                                           TM13
                ****  *  **** ***** ** *** ***********  ***  *** *****  *

TM15              extracellular     TM16
mScn9a   1231  FTYIFILEMLLKWVAYGYKTYFTNAWCWLDFLIVDSLVTLVANTLGYSDLGPIKSLRTL  1290
hSCN2A   1249  FTYIFILEMLLKWVAYGFQVYFTNAWCWLDFLIVDSLVSLVSLTANALGYSELGAIKSLRTL  1308
                         cytoplasmic
                **********  ***** *  ****************  *  * ** ***  * ****

TM17                extracellular
mScn9a   1291  RALRPLRALSFEGMRVVVNALIGAIPSIMNVLLVCLIFWLIFSIMGVNLFAGKFYECVN   1350
hSCN2A   1309  RALRPLRALSFEGMRVVVNALLGAIPSIMNVLLVCLIFWLIFSIMGVNLFAGKFYHCIN   1368
                         cytoplasmic                                    Pore-forming
                **************** ** *************** **** * mScn9a   1351  TTDGSRFSVSQVANRSECFALMNVSGNVRWKNLKVNFDNVGLGYLSLLQVATFKGWMDIM  1410
hSCN2A   1369  YTTGEMFDVSVVNNYSECKALIESNQTARWKNVKVNFDNVGLGYLSLLQVATFKGWMDIM  1428
                                extracellular                TM18
                 * *   * **  *  *     * * ********************** cytoplasmic
mScn9a   1411  YAAVDSVNVNAQPIYEYNLYMYIYFVIFIIFGSFFTLNLFIGVIIDNFNQQKKKLGGQDI  1470
hSCN2A   1429  YAAVDSRNVELQPKYEDNLYMYLYFIVLFIIFGSFFTLNLFIGVIIDNFNQQKKKFGGQDI  1488
                                                            TM19
                ****   **  *  * ** * ******************* *** cytoplasmic
mScn9a   1471  FMTEEQKKYYNAMKKLGSKKPQKPIPRPGNKFQGCIFDLVTNQAFDITIMVLICLNMVTM  1530
hSCN2A   1489  FMTEEQKKYYNAMKKLGSKKPQKPIPRPANKFQGMVFDFVTKQVFDISIMILICLNMVTM  1548
                                                  TM20                 TM21
                ********************   * *   * * *** * ****** extracellular
mScn9a   1531  MVEKEGQTDYMSFVLIYWINVVFIILLFTGECVLKLISLRHYYFTLGWNIFDFVVILSIVG  1590
hSCN2A   1549  MVETDDQSQEMNILYWINLVFIVLFTGECVLKLISLRYYFFTLGWNIFDFVVILSIVG   1608
                         cytoplasmic
                ***    * *    ****** **  ******** ***** *** **************
```

FIG. 1D (cont'd)

```
                        extracellular           TM22                    cytoplasmic
mScn9a  1591 MELAEMIEKYFVSPTLFRVIRLARIGRILRLIKGAKGIRTLLFALMMSLPALFNIGLLLF 1650
hSCN2A  1609 MELAELIEKYFVSPTLFRVIRLARIGRILRLIKGAKGIRTLLFALMMSLPALFNIGLLLF 1668
             **  ***********************************************:*******

Pore-forming
                                       extracellular
mScn9a  1651 LVMFIYAIFGMSNFAYVKKEAGINDMFNFETFGNSMICLFQITTSAGWDGLLAPILNSAP 1710
hSCN2A  1669 LVMFIYAIFGMSNFAYVKREVGIDDMFNFETFGNSMICLFQITTSAGWDGLLAPILNSGP 1728
             *****************:*  :*********************************** extracellular            TM24             cytoplasmic
mScn9a  1711 PDCDPKKVHPGSSVEGDCGNPSVGIFYFVSYIIISFLVVVNMYIAVILENFSVATEESTE 1770
hSCN2A  1729 PDCDPDKDHPGSSVKGDCGNPSVGIFFFVSYIIISFLVVVNMYIAVILENFSVATEESAE 1788
             ***.:.**:****.:*****************************:* cytoplasmic
mScn9a  1771 PLSEDDFEMFYEVWEKFDPDATQFIEFCKLSDFAAALDPPLLIAKPNKVQLIAMDLPMVS 1830
hSCN2A  1789 PLSEDDFEMFYEVWEKFDPDATQFIEFAKLSDFADADPPLLIAKPNKVQLIAMDLPMVS 1848
             *************************  ***:* ******************** cytoplasmic
mScn9a  1831 GDRIHCLDILFAFTKRVLGESGEMDSLRSQMEERFMSANPSKVSYEPITTTLKRKQEDVS 1890
hSCN2A  1849 GDRIHCLDILFAFTKRVLGESGEMDALRIQMEERFMASNPSKVSYEPITTTLKRKQEEVS 1908
             *************************:** ******:*:******************:**

cytoplasmic
mScn9a  1891 ATTIQRAYRRYRLRQNVKNISSIYIKD-GDRDDDLPNKEDIVFDNVNENSSPEKTDATAS 1949
hSCN2A  1909 AITIQRAYRRYLLKQKVKKVSSIYKKDKGKECDGTPIKEDTLIDKLNENSTPEKTDMTPS 1968
             *: *******  *:*. .  * :  ****  ::*  :*:***  * cytoplasmic
mScn9a  1950 TISPPSYDSVTKPDQEKYETDKTEKEDKEKD--ESRK 1984
hSCN2A  1969 TTSPPSYDSVTKPEKEKFEKDKSEKEDKGKDIRESKK 2005
             * **********::** *:**.******* ** ***:
```

```
gcctcttaggtaaggatccgaaggggaaataaaacctacaggatgagaagCGTCGACGATGGCA
CAGTCAGTGCTGGTACCGCCAGGACCTGACAGCTTCCGCTTCTTTACCAGGGAATCCCTTGCTG
CTATTGAACAACGCATTGCAGAAGAGAAAGCTAAGAGACCCAAACAGGAACGCAAGGATGAGGA
TGATGAAAATGGCCCAAAGCCAAACAGTGACTTGGAAGCAGGAAAATCTCTTCCATTTATTTAT
GGAGACATTCCTCCAGAGATGGTGTCAGTGCCCCTGGAGGATCTGGACCCCTACTATATCAATA
AGAAAGTGAGTTCTTAGTCAAGTTGCCTTCACTGCCTATTTACTAATTGGTTCTGGGCTAGTCC
CAGGGATGATGGTGAAGAAGGCTGGCCTCCTTCCCTCTGTCTAAAGTATCACTAAGATGCTGGA
TGGGCCTGACCGTGTAATGGACCAATGATCCTAGAAGTCTTTTGGAAGCACTCATTTGAACCTG
CATTTGTGAGACAGGCAGAGAACTGGTGAGGCATCCTCCAGCGCGGGAATTAAGGAAGGACAAA
AGCCTATTCACCTTCTTGAATACAAATTATATGCTTAAACCAGTGTAAATTGACCCTGATTCCC
TAATAATGTTGAGAAGCAAAAACTGTAAACTAGGAGTCTATTTAAATTTTATTTTTTATATTTG
CAGGAGTAGTATCTAAATTCCTCTTTATAGTCTCTAGCTCTCCATAAGTCACTTTGATCTTCAG
TGGGTTTAATTATTCCTTTATACCATACTTTCTCCTTTCTATTGCTCTCCACAGAAGGAATAAT
AGCAGGTGACTTGTAGGTGCCAAATAAGATTCTGAGCAAGAACACACCTGGAAAACCTTGAAG
TTCTCATGAGAAATTTTCTAACCAAAAAAAAAATCAAAGCCTCAATTTTGTGCTTTATGTGA
ATTATAAATGCGGTTTTAAAATACTTACATTAAAACTTGATAAAGTTGCTAAGAATTCCTATGG
CATTGATCACAAATTTTCTTAATAATCCTCATGTCATTTATCAAATTTAGGAAAGTTTATAGTG
CTCAGAAAAAAAAGCATCTATCTTCATGTCATATGATGGTAATTATTATGTTATACACTATTT
TACAGGGCAATATTTATAAATAATGGTTTTACTTTTCTCTTAAAATATTCTTAATATATATTCT
AAGTTTTATTTTATGTGTTGTGTTTTCTTTTTCAGACGTTTATAGTATTGAATAAAGGGAAAGC
AATCTCTCGATTCAGTGCCACCCCTGCCCTTTACATTTTAACTCCCTTCAACCCTATTAGAAAA
TTAGCTATTAAGATTTTGGTACATTCATATCCTTTTTCAAATCGTCACTTAATATGATTTTCTT
CTTTGACCAAGTTATTGAGCTACACATTTTCCAAAATATCTGTGGTTGGCAATGTTATGTGTTC
TTTCTTTTTCTTTCCTTTTACTCAATCGTTAGCATGTTGCAAAATGAGATCACAGGTAAGTGAA
TTACTTTCCCCGTCTTCTAAGTGTTTCTTCTCTACCCAACTCACTATTACTTCTTTCTTCTCT
TTTCTTCTCCCTTACGAATTGCTTGCCACATCCCAAGCCTTTCTCATTAATTTTGACCATGTTA
CCAGGCTTTCCTCCTGTAAGTCTTCAATTTACAATGTTAGGTAAGGGAGTAAACTCCATGAGCT
AATTTTCTTTACTGCTTTTACATTTGGAAAATAAATATACATAATCTGAATTACAATTTTGTAT
GTTTTTGGTCTGAATTTTATGACTTTCTTCTATTTTAGCATTTAAAAGCTTTGAGTTAGTAAGC
GTTTACAATTGTGTCTGTAGGTATAACACCCTTTCAAATACTTTTCCAAATTTGTTTCGCAACA
GCCTTCTTATTGATCTTTTGCTTTCTATTCTTTTCCTTTCTTTTTCTTTTTATCACTTGTTCCT
ATGTTTTATTGAAGTCACAAGTCTTGCTACAATTATCCCTCTCCAAAGGATTAATGTCTATCTA
TCCATATACATTCTCATTTTATTTTTTATACTCCTTATTGAAGCACCTGCTTTCCAAAAATGAG
ATTGATGACATCTTGGTGGGAGATGGCAATTTGATTGATTCCTTGAAATTAAATAGAGTAGTTG
GAAATGAGAGATTTTATTCTAGGCCAGAAACAAGTCTTGTTGACAGCCAGTCTTGGGAATGCCA
ATGAAGCAAAGGCTTGGAAGACTGAAGCTGTGTGGGCAGGGCATTTACACGAAGAACACAGA
AGTCATGGAGGAGGAGTGATATGCTTCAGGAATCAGAGGTAAGGCAGGGAACTGAAATTAAG
CAAATCCTCAGATTAGGACAGCATGTTATTTCTTCTTCAGAAAGAATCGTTGCTTGGAATTCCA
TGATGTGGTTAGCCCAGGGCCTGGTATTAAGGCTTTCAGTATAAATATTCTCCACCTTTAGCAG
GCCTAGAAAATATTTGAATTAGATAAGGTATGGAACTAAATTAAGTAGGGAATTCAGGAAATGG
GATAAGCCTGGTACAGGGTACTTATGTCATTTCTGGGTGGAGGGGATGTAAAGCATGTCCCTAG
ACTTGCCTCCCAGTATGGCAAATGTTGTCTTTAGAAGTGTAACATTCTGTAAAGTCTCCTTTTA
ACCTCTAGGTTGTTCCTCTTCCCCAGTTTAGGTGGATATCAACATCTTTATTTGATGTTTATG
TTTCATGTTTTAAGATTTCCTAGTTTCTTGGCATTACCTTAAGCAATAATGTTTTCTTACCTCT
CTCTGTTTTCCAAATAAGAGAACCCAGTAGCATGTGGGGAAAAAGATGTCTTTGAGTTAGCATT
```

FIG. 6

```
AGAAATAAATAATAAAGTTGGAATTTATATTTGGGTCTCATGATTATAAATTATGATCTATTAT
TATGTTTCAAGCATTTGTAATCTGTGCAGTGAATAAATCTCTGCATAAACTATTCATTATATTT
TAAAATAATTGTATGTTCCTTATGCAAACGTAATTTATATATAAAATTACGTGGAAAATTCTAG
CCTAGAACTAGACTTCTGTTCCTAGTAGACATTGGGAAATATTCATTAAATAAATAAGTGACT
AGTAAGTCAGAGATTAGAGAATCAGATACAAAAAAGTGAAAAATAAGTTTGAATGGATCAGA
AAAAATCTTTCTTGTCGTGCATCTGAATGATGAGATGGAGTTAAGAAAACCCAATATATTTGTT
TTTTACAAAAGCAGATTTTTGTTTAAAACTTTTGTAATAGACCATGGAAAATCTCATGAAAAC
TATTGTCCCCACTTGAAAAAAAAATCCTAGGAGATTATGAATCCCCATTTAAAACTCCCTGGA
AAAGAGACTCCTGGTGGTAGAGGGTAAGGCAGTTTAAGAAATTCTGATCAGAGAATATGAGTA
CTAAGGACACAGTTTGTGCCAGGACCTCTCTAGATATCCAGATACAACTTGAATCTGTGGGCTT
GTATTTGCTTCCTGGGGAAAGAACTCACCCTCCACAGGCTGAAGTCATTGGGAGGCCTGAGGA
GATGCAGGTTGAAATGTGAAGCCAGCCAGGCAAATCTATTAAGGTATGCCAAGTTGAGCTGTTG
ATTCTCTGAGAAGTTTACAGATGGCTTAGAGTCACAAATTTATTCCAATGTAGAAAATTAGATT
TTAAAAGTCTCTAATTTCCTGACTTAAAGTGTTATATTTCAGATGTCTCACCTTGGAGCAGAG
ATATAACAAAAGGCAGTGAGGCTAATAGTCTAAGATACATGAATCCTTCCATGTTTTGGTGATG
CTGGTGCAATTGATCAAATAGCCCAGTAAAGTTAGAGGTATATAGATGCTGTAGTTAGTAACTG
ATTTTCACAATAATTTTGTCCTTTATTCCTCTTGTTGCAAACCCTAGACTTAAATCCTGATTTT
CTGACTTCAAGTACAGTGTCTTTTACTGTAAGTTAAAAATGCTTGGAGAGATGGTCATGGTTGT
TTGGCCACAGTTGGGAGGTCATTGTATATTTATTACCACTAGTTTATAAACCAACAAGGAGCCA
TTCATGTTAAATAAGTTTTTATTTTAAACTTGGACTAATACCTCTATTTCAAACAAAAACCTTG
ACTTGTTTCTCAAAGAGCTGTTATCTATTAGGAGCTATTGTGTATCAAATTAGCTTTTTTAAAA
ATTTATTTTGGCTGAATGAGAAATTATGCTTGTGATATTTTTACCAGGGTGCATTCTGAAAACT
GAAAATTCTTTTGATGTGCCTAGTGTCTTATTTGATATTTAAATAAAACATGATTTATTTTCTA
GATAACAAACAAGTTAAAAATAATCTATGTTCCTAAAGTTCCCTACCAAGCTTTTAAATGTGTT
TCCTGTCAGCTTTTATTATTTAAGTTAATATATGCACACTCCTCTAATTTATTTTGCATTTGT
TACTCATTTGTTCATTTGCAAGTACTTACTGAGTATCTACCATGTGGTAGATATTCTTGTAAGC
ATTGGGATGCAACATTGAACAAAGTGAAGTTCCTACTCTCATGTAGTTACATTCATGTGAGTGT
GTGTGTGTGTTTGGAAGAAGAAAGACAATAAACAAATACGTCGATTGGGAGCTAGTGATAAGTG
TTACTAAGAAATATAAATTAGTGTCAAAGGGAGGAGTGACAAGGTGTTGTTTTAGATTGTATGG
CCAGTAAAATCCTTTCTGAAAAGGTACCAGTTGAGCAGAGATCCGAAGGAAGCAAAAGAGTGAG
ATATGGGAATCTAGGGATAAAGTCAGTTCAAGGAGAACAGCAAGTATGAAGGTAAAGTCTGAAG
GTGGTGGTGCAACTAGTATGTTTAACAATCAGCAAGGAGACCTGAGTGGCTGGAGCAGAGTGGG
AAAGGCAGGAAGCGAGAGGATGACATCAGTGGGAGTGAAGGTCAGGGCTAAAGTTGTAGGCGA
GGTGCAGTGGGTCATTGTGAGGACACCACATTTACTCTGAATGAGACTCCAGGAGGGTTTCAG
TAGCAGGATATCATGACTTGACTCACATATTTAAAAGATCACTCTGGCTGCTTCATGGAGAATA
GACTGCATAAGGGGAAGAGTGGAAGCAAGGAGACTGGGACCGATTGTCATTATGAAGGCAAGA
GAGCATGGTGGCTTGGAGTATGGTGGAAACAATGAGGATGGTAAAATGTCATCAAATTTTGAGG
TATTTTGCAGAAGAGCTGACAGGATTTGCTGAGCAATTGGTTGTGGTGTATAGGAGGAAGGCAG
GGACTAAGGATGATTCCAAGCATTTAGTCTGGTCAAGAAAGAAAATGGAGTTGTGTTGACTGA
GCTTGGGGCAACTTGAGCAAACCAATTTGGTGGGTAAGATCAAGATCTTGGTTTTGAACATGTT
ATGTTTGAGACACCTATTAGACATCATTGGAGGAGTTGAGGAGTTAGGTGGCTGTGCAAATCTG
GAGTTCAGAAAAGGGCTGGGCTGGAGGTGTTCAACTTTGGGAGCTGTCAGTGTACAGCTGGTAT
TTAAAGTCATGACATTGGACTAGGCTGCCAAAGAGCTGAGACCCTCCCTCCAAATCACACTAGT
AATGCTGAACTACCTATCATTTGAAAATGGTAGGAAATGGAAAACATAGGTTTTGGTATCAGA
AAACGTAGATTCAAACCCTATCTCTAAAATTTACTTTTTAGCTATATGATCTTAGTCCAAGTTA
```

FIG. 6 (cont'd)

```
CTCCAATTCTTTCGAATCTCAGTTTCTCTATCTGTAAAATTATAATCACAGCTTAGACATTAAT
AATGATAAAATGTATGACAAGTATCTAGCACCAGATCCCATGCTAGTACTTAGTAGGTACTCAA
TAAAGGATATCTATGACAGTAATAGCTAAAATTCTAGCAGCAACTGCTGTAAGATTAGCAAAAA
GGAAACTCTCATATTCCTTAAGGAATTGCACAAAGAACTTTATAGAAATCCCTACTCTGACTCT
GCAAACAAATCTTTATATAGCACCAGAGTTTAGACCTGCAACTGACCCAAACAATGTGGTCAG
TTCTGTCTCATTTTGTAGATGAGTTCACTGAAACCCAGAGATATTTAGTTTTTTCTAAGGCTAC
ATTTTCTATCAGTGGCAGAGCTAAAACTTCAGACCAGGTTTTTGATTCTTGGCTCTTTGCATT
TTGCATCCAATAGAAAACAAATGATTTTTAAACCCTCGGATTTAATATACTTGGGGCATTGCCA
GTGTTCTTGTTTATGCATTTCAAAGGTGCTTCTTAGTTGCTCCAACTTACTGATTCATTAAAT
AGTGTCCATACTGAGATATAAAATATCATGGTTTTCCATGAAAGAAATATACAGGTTTATATG
AAAGCAGATGACACAACAATTTCTCTTTCTTTTGTTTTCAATGCTCATATGTTATCATTTAGTT
ATCTACTGGCAAATAGGAGTTTGTTCATATTAAAATTAAACAATCCAATATTTAACACTGTATA
TGTGACATTTACTCGATTTTTCTGCTGGCTCAGAAATATGCACTGGTATGCAGAAAAAGACCTA
TTCTATTCTACTTCAAATTATCCATTTTACATTAGAAACCTCTAACATCAGGCTATCTTCTA
CTTCTAGTTTATATATAGGTTAAAAACTCCTCTGCAACTTCTCTGGATATTATACATTATTACA
AAGTCTCTGAACAGAGCATAATGTCTTTTCCTTCCTATAGAATAACAAAGAAATGTCCTATAAT
TTTATACTCTATAAATGAGTTATTAATGGTAAGAAACCAATAATTATTATCTTAGTGGATAATG
ACTGTATACTGTAAGAAAAGTATTATCCACATTTATATAAGAAAACTGAGCCTCAAAGAATTAA
ACAAATTGCTGAAGCCCACATGGCTGGTAAGGGATGTATCTGACCATGGTTCATTGCTCTAAAT
CTCATGGTGCTTCATCCTCGCTCCACGGAGACAGGGGTGGGTGTGCCAGTGTTATGATGATCCA
GGCTCCATGTCAAGGGCTACTTAAACAATTTTCACTAAAAACTTGAAGAAGTGTTTCTTCATAA
TATACACAAAGGAAATATTTTACATTGCCAACTCGCAGGTTAGTATCAATCAACAGGTTTACC
CACTGTTATGTATACCTGGCATAAAGAAATTAATAGATTAAAAAACATCTTTGTCCCTGATAT
TATAAAAGGTTTATCTGCCTCTATTTTATTTTACATTGAAAAGTTCTTAAAGCAATATTGTTCC
AGGATACAGTGTTCTTTTGAAAAATGTACTCTATGACTTGGATTACACATTTAAAAAATAATAT
AGGATGTATGCATTTTGCTACTAGTTTGAGCCTTTTGAAATCTGCTTTGACGTGGGGTTTCTAT
ACTTTTTTGATGCATGGCATCACCAATGCAAAATCCATACCTACATTAAATACTTTTGTATTTG
AGTTTTTGTTATTTGAGTTTTTTTTTTTTTTTTTTTTTTGAGACGGGTTCTCGCTCTGTCGCC
CTGGCTGGAGTGCAGCAGCGCAATCTCGGCTCACTGCAAGCTCCGCCTTCCGGGTTCACGCCAT
TCTCCTGCCTCAGCCTCCGGAGTAGCTGGGACTACAGGCGCCCGCCACCACGCCCGGCTGATTT
TTTGTAATTTTAGTAGAGACGGTATTTCACCGTGTTAGCCAGGGTGGTCTCGATCTCCTGACCT
CGTGATCCGCCCGCCTCGGCCTCCCAAAGTGCTGGGATTACAGGCGTGAGCCACCGCGCCTGGC
CATATTTGAGTATTTTAAGATCATCTGAAACTATTTCAGTCACTCACCAGAATCCAGGAATTT
GTAAAGTATGTGACTGATGAAATAAATTAACAATGATTTAGAAACTTAGTGAATTTTAAGCCTT
TCTATTTAGAGATACCTATCAAACCACAAGCGTAAAAACTTGACCCTAGTTATCTACTATTTTT
CTATTAAAAGCAAAATTGTTCTTTTTATGTATCAGAAGTTTTAACTTAAGTGTATACTTTTATT
AAAATGATAGCCATGAAATAAGGAAAATGCCTGTTTTCGACTTATTATCAGTGACTAATTAGAA
AATAATTATTTCTCTTGTTAATGTTGAAATATATATTTTACTTTTTTATATATAACTAAATTAT
ACCACTATAAAGAGTAAGTTTTTAAGTGTCATAAAACCATTGCCGAGTCCATAATGCAGCATAA
TTGCATAAGGCTGTTAATTTCCACCTTATATTTTTCTTATATTTTTACCCTCAAAAAATGTAGA
AACTTGTGTAAACAATATGTATATATATTTTAGACAGAGTCTCACTCTGTCACCCAGGCTGGAG
TGCAATGGCGTGATCTTGGCTCACTGCTACCTCTGCCTCCTGGGTTCAAGTGATTCCCCTGCCT
TAGCCTCCTGATTAGCTGGGATTACAGGCATCCGTCACGCCTGGCTAATTTTGTATTTTTAGT
AGAGACAGAGTTTCACCATTTTACCCGGGCTGGTCTCAAACTCCTAACCTCAAGTGATCTGCCT
GCCTCAGCCTCCTGAAATGCTGAGATTATAGGCGAGAGCCATGGCACCTGGCCAACAATATATT
```

FIG. 6 (cont'd)

```
TGAAGACAAACTTTATGCTGTATTTTTAAATAATTTATCAGAAATTGTTTTTAAAAACTCCATT
TAGTAACAAATGAATTGCAAAATTAATTTCATTAGTCAACTGACACTGTGAAATAGCAAGGCTA
TAATGGTGAATAATATAGACATGATTCCTGTCCTCATGACGCTCAGAGAGTAGTTGAGAAGATC
ATCATTAAAATTTGTCATTAGAGGAATAATATAAGGGCTGCTGGGGTATATAACTGGTAATAGG
TCAATCTGAGTACTAAAGAAAAGAGAGGTGACATTTCCAAGACCCTAAAGTCAGAAACAGCAT
ATAAAACATTCATAACATTTGACAACCTAAAATAATTACAGTATTATCCAAATGGGGATAATGC
AATGAAGAGAAAAGAAAATGAAACTGGAGAAGTAGACAGGGATCAGACCTCCTAGCGTCTTGAC
TCTGTGTTAAGACATTTGATCATCATCCTAAGAGTAATAGAAAGCTACCAAAATGATGCATATT
ACATTTACAATGGTCGTGTTAGCACAGTATGCAGAATGGATTAAATGGAGCCAAACATGAATTT
GGAAACATCAGTTTAGAGGAGACTGCAATAATCTAGATGGACTATTAGATTTGATGCTAGTCTT
GACAGACACTTGGACCATGCAGTGATATGGGGATGGAAAAAGTAACTGAATCCAGAGATAGCA
GGCAGAATTGACAATATTTGATGGTTAATTAGATATGAACGTTTAAGGGGAGACAGAAATCTAA
GATTTCTCATAGGTCTCTGGCTATATTATGCACATTTTATAAGACACAGAGACGTCAAAGGAGT
AAGTAATTAGCAGGAATGGAGGGGTAGATTAAAAGATACTTTTCAAAAGTTCAGTTTTAGAATT
CAAAATTTGAAGTGTTGATAAGATATGTAAGTACAGATGTCCTATGGACAATCAAGTATGTGGA
ATTCAGAAGAGCGGTCTCACTTGGAGAGAAGTATCTGAGAATGGTGGGTATATAATGGTTATGT
TTGTTGAGCAATGTTTGTTGATGGACTACACTAGGATGAGGAGAGTAGAAGAGAGGTAGATGGC
TTACATACCTTATGTCTTTCTTTTCAAAAGAAAAATGCCACATTTCAAAGAATACAGAGAAAT
TGGTGCCCTGAGGCATGAAGAAGCCAGGGAATTGGAACCTCCTGAAAGCAGAGGGAAGATAACT
TAATGCTAAGGGGAGGAACCATCCTTGTTGAATGCTGCTTAGAAAGCATGTCAAATATAATCTC
AAATTATCCTTTTGTTTTAGTGACAAAACGTGAAGATGTTGCCATCTTTAGAAAGAAAAGCTG
GTAGGCTGAATATATGATAGATATATAAGAAAAGGAAAGATAAGCAGCTCTTTCAAAAAGTTTG
GCCATGATATGGAAAAGGGAGATAAGGCTGTAGTAGTTAAGGAGGGTTGTGAGTCATAGGAGAG
AAATATCCTTTCCCCTATGCCAGGACAAGGGAGACGTAAGCAAGTTTGTGTTGCTGGGAAAAAG
CCAGTAAGGTGGGAGCCATTAAGGATAAGAAAAGAGAGAGATAAGAGATTGCTGAAGTCTTCTG
GAATGGGGAAGGTGTCCAGAATACCGGTGGAGGGATTGGAAACCTCCCCACTGTAACAGGAAGG
AGGAAAGAATTGGTCTCAATGTGGAAAGTTTGTTGATTTGGGGGTGGGAAGTGGAGGCGGGGC
ATTGTGATGCTGTCTCTTCTCTGTAAAGTAGAAAATAAGTTTTCAGCTTGAAATGGAGCCGGAA
GAAAGAAGAGGGTTGGAAGCTGGAGGAAAGTGGAGAATATTTGAAATTTTTCTTTGCAGAGAGT
GGGAGATGGAGCCTAGTAGGAAAATACAGGACTGTGTTGAGGACCACTGAGGTTTGTGACCATA
AATTTAGAATGGTGCCAATCTGCCACGGGGTGTTATTTTCCCCAATAGGGCTCAGCAGACCAA
CAAGCACAGGGGACCCTCTAGTTTTATATACCAATAGCAAGTCATTCTTTATTTAATTTAGTTT
TTTGTTTGTTATAGCAATAAAGAAAATTGTGTTTCTTTGAAATGGTATTTTGTGTGTGTGT
GTGTGTGTGTGTGTGTGTGTGTGTGTGTGTGTTCTCTAGATTATAGTGCCCTCACGTGGC
TGATGCACATCATTTACTTATGAGTGTTTTCATATGGATGAAAAACTGAGAATTAAGCATGGG
CCTTACAGCACAGCTACTAAAATTAAAAAATAATAATTATTATTATTGTTTTGACTAAAACCAG
TACTAGATGCAAATGAACTTTCTTTCTAGATCAACACAACATTGTCCAGTTGTAATAGTGTTGA
TATTTCATTATGTGTAAGTAATGTGATCATTTATAGTAAAACATTAGGAGTGAGAAAAGATAT
GAAGAGCACGTATTTCCTCTCTGGAATTTCTATAATTGTGTCCAGATTCACAATGATAAAGAGT
GCCACTTTACATAATGGCAACTAAATCTTTATTATGCTTTTATTAAATATGAAAGTCATTACT
ATTATCTGATACTGAATATTTTCTTAAATAGTTGTTTTGGTTTTTGTCTTTTGCTGTTTTTAA
TGTCAAGGAAAGTGAAGGGCATTGGCTATACCTGCAAAGACAAAGTGGGATAGGGTGAAACCAA
CCCAATATTTGTAATAAACTGTGTTCTGTATGATCCAGGAAGCAATTCATTGAGCATCTATTAC
GCACTAGGGCCATTAAGTTGAAGGAGACTTACATATTTTAACAAATTTGATCTTCATAGCAATC
CTGTTACATGATTACTTTTTCTTACTTTTATAACCAAGTCAATTGAGATTCAGGGAACTTAATA
```

FIG. 6 (cont'd)

```
AGTAATTTTGCCTTAGTTACAAACCCCAGAAATGCCAGTGCTAACACCTGCCATCTTCTCTCAT
AGTTCAGGATTTTATGAGCAATTACAGTATATTATACCCTCTGTTTAGAAAGGACCTTATTATA
AGACATTCCACCAGGGTAACTTTTAGAATGATGTTATAATACATTTAATTAATTACTTGAATTG
TCTTGTTGAATTTTTGCCAGGGTTTACATATGTGCTGAACTTGCAGTTTTAATGTTCAGTTGAG
TCTGTCGTTAAGAAAATTTAAGTTGATAAATTATTCACTGATGAACTACTTTCTTTGCATTTAA
TCTTTTTAATTGCTAAAGGTACCTAAATAGCCTCAAAATAGTTGATGGCTTGGCCTGAAGACAA
GATCTAAATATGAGGTTGCTGAGTTATAGAAATGGCAAAAAAAGGGTCAATAATAGAATAATA
AGCAACAAATAATAGTAAGCACTAAAGTTTTAAACTTCATGGTGGTGAAGGCATGGTAGTGCA
TAAAAGTAAGATTTTTCCATTGAACTTTGTCTTCCTTGACGATATTCTACTTTATTCAATATGC
TCATTATGTGCACGATTCTTACCAACTGTGTATTTATGACCATGAGTAACCCTCCAGACTGGAC
AAAGAATGTGGAGTAAGTATAAATATTTTCAATATTGACCTCCCTTTATGTTTCATATTGTGC
TTTTAACACCTTGAGACCTCCTCAATTTCTTTAACAAATCATGCTAGCTACTGTTAACCAGACC
CTGATTCAAATTCATTTCTGTCACTAAATGTCTTCTAGGACAAAGCTTGTAGTGGGCTCACTTA
GTTGTGTAAATTACTGCAGTAGTTTGACTGCTATTATCTGCAGCCCTTTATCTTCTTTGTGAGT
CTTATGTTCTTTGAAGATCACCAGTGATTACTAATATCTACTGATAAAAGTATACCTAGTT
TTTATGTTCCTTTTTAATGACTACCACAGTTCTGTGTTACTAGTATATGTTTGATGGCTTTTA
ATGGTGCATATTTTATGAAATACAAATGCTTCACTCATTTTGTATTAATACCTATTTGCTCAA
ATCGGACTGAATGCCAGTGTATTTCAGATTATGTCTTCATATAGAGCCACATTATTTGGATCCT
TTAAATTAATTAATGTGGAAAATGCAATATACATTTATTTACAGTCAATGAGAATGTCTTTTGG
AATTTAATGTTTCTTTTTTGACTTAAGCCCCACCTAAACTCTATATCGTAGGGGACCAACCTG
GAAGTGTCTAATTTTTGTTTGCTGTTTATGTCATCTTTAAGATATGTACTTGTAAATTAACCAC
TAGATTTTTAATGTGAGCTTGGCTATTTTCTCTCAGGTATACCTTTACAGGAATTTATACTTTT
GAATCACTTATTAAAATACTTGCAAGGGGCTTTTGTTTAGAAGATTTCACATTTTTACGGGATC
CATGGAATTGGTTGGATTTCACAGTCATTACTTTTGCGTAAGTATCTTAATACATTTTCTATCC
TGGAAGAGTAAATCACTGGTGGGAGCCTATACTATATTTTCCTTGGTGGCTTGCCTTGACAGAC
CAAGCATTTTTCTTAGTAATCATAGTTTTCTTCCAATCAAATTATCCAGTTTGGAGAAATTAGG
AACTATCATAGTAAATTACATGGCTTTGGTTTCAATTAGCACTGTAAAGTAATAAAGTTTCCCA
AATAACAGAGATTATGATTGATGACAATGCCATTTTCCTCTTAATTGGGAAAGCTGATGGCGAC
ACTCATGAAATTAAAAAGGTCTTGATGAAAGACCAAGGAAGACGTAGATTTCCCTAAATTCTGA
ATAACTCTGATTTAATTCTACAGGTATGTAACAGAATTTGTAAACCTAGGCAATGTTTCAGCTC
TTCGAACTTTCAGAGTCTTGAGAGCTTTGAAAACTATTTCTGTAATTCCAGGTAAGAAGAAAAT
GGTATAAGGTGGTAGGCCCCTTATATCTCCAACTGTTTCTTGTGTTCTGTCATTGTGTTTGTGT
GTGAACCCCTATTACAGATATGTGACAGAGTTTGTGGACCTGGGCAATGTCTCAGCGTTGAGA
ACATTCAGAGTTCTCCGAGCATTGAAAACAATTTCAGTCATTCCAGGTGAGAGCTAGGTTAAAC
ACCGAGGCTGACTTTAGCTACAGTGGTGCTACAATCACAGCTTTTGTGCAGAAGCCTTGTTGCT
AGTTGCATATTGCAAATAAATATGTAAAAAGCAAGAATTGGTACATCATTTTTGGATGGATT
TGATTCTTTGCTTTTTACTCGTTGCTTTCTTTAAAACTATTCTAAATCAGCCTTTGAGTTTAAC
AAGTGTTGCATGAGGCATTTGCAGTAACAGGCTACATGGTTTGCATCCTATAACATCAAGCTTT
CCGCATAGAAGCTAGACTAAGAGACATTCAGACTGATGCAAATTTGACAGTTTAGGCCTAAAAC
TGGCAATCTTTTAAGCTGCAGATAAATGAAAGAGCAAGGGATAGCATGAGTGCTGCATGGGCT
CAGATTTCAGATGTCTTCCTTTTTTTAACCCATACTCAAGCTTGCAGAATTCACAAATATATAA
CCTCATAATTCATCGACTTCAAGATTTCTTACTACTCTATTCACATAGACTTTTCTAAAACCAA
TAAGGGGTTAGGGAGTAAGACATCTGCAAATAAAGCAAATATTTACACAAGGTTGATGTTTA
AGCATGAATAACAAAATCATTCTTTTGCTCTAAAGAGTGTTTGGAAATACACATTTGGTTCATT
TCCATTCACAGTTTTCTAATGAACATACAAGTTCTGCTTTCATTCATTTTCACCAGCTAGCAGG
```

FIG. 6 (cont'd)

```
CTTTTCATGAAAATGTTATTCAATCACAAACATTAAACTAATATTGTTGGCATTCTGCATGACA
TTTTTATTTTCCAGGACAAGCTCATGATATTTTGCCGGTAAAATAGCTGTTGAGTAGTATATT
TAAATTCCCCCTTCTGATTTTGTTTGTAGGCCTGAAGACCATTGTGGGGCCCTGATCCAGTCA
GTGAAGAAGCTTTCTGATGTCATGATCTTGACTGTGTTCTGTCTAAGCGTGTTTGCGCTAATAG
GATTGCAGTTGTTCATGGGCAACCTACGAAATAAATGTTTGCAATGGCCTCCAGATAATTCTTC
CTTTGAAATAAATATCACTTCCTTCTTTAACAATTCATTGGATGGGAATGGTACTACTTTCAAT
AGGACAGTGAGCATATTAACTGGGATGAATATATTGAGGATAAAAGTAAGATATACTCTATAA
ACCATTAAGTTGTTTAGTTCTCTAAATATTAAATATTATATATAATGGAAATTATCTCAATTTA
GATGTGAATCAAGTGACTTAGACTAATTTAAGATGATTTAATACATATAAAAGAGATATCAAAT
GATACCTTATTCTATTTTTCTTATCTGTCCATTGATATAGTAAAAGTTCTCATTTGAAAATGTG
TTGTCTTATACTCATGTTGAAAGTAATTTCATATTATGCCATATTAAAAAATGTTTATTTGGTA
GACATTAATCAGGTTTTTCAGTCATTTTAATAAATAAGTCAGTAGTTTGAACTATTCAGTGTAT
TCCACTGAAATGTGTTAAGAAGACTGAGGGGAAATAATTTGGCCCTATTTGGTTGATGCAACAT
ATGTATTGAGTACATATGCTATATCTGAAAATAGAGAAACCATTTATCAAGATGAAATAAGAAT
TTGTGTGCTCCTCAGAAGGTTAAGTAACCCTGATTTAGCCATTCACTTATTCATATTCTAATTA
GTCCCTTTAGTGTCATCATTGTATTGTAGTTACCAGTTTAGTTTGATTATATTTAAGGTATGAA
CATCAGAATAAGCTTATGCCATATACTTCAGCATGATTTCTTAACATTGAGCCCAGCCCCTCTG
TCATTTTTCATATGTGTGTGCATGTTTGTATGTGAATATAAAAATACGTATGTTTGCATGTGTG
TGCATGTTTTCTGAGATCATCTTTGCAACTTACTGAAGTTATATGTCATGCCTTAAAAATAAAA
ACTAGATAGCTCTCCATAGCTTAAAAATAAAAACTAGATATACTCAGACAACATATCTCTCCAA
AGAAACAAGTTTATTTTCTTCATTTGAAAGGCAGAAATCAAGCAAAAATTTCAAACAAAACACT
TATTACAGTATCATAAGAGGGAATAAATACCTAATCCCACTTCTCACAGGAAATTAAGTTAAA
ATTGGCGGGAAAAAATGTCTGAATCTATTTTGAGCCTGGGGAGAAAAGTATATGTAAGGTAAAA
TTTATTTGCATGAAAACACCTAGAAACAACAAGGCTTTCTTCTTTCTTACTTTTTGTGCCCAGC
AATAGACTGGCAGCTCTTTCTTAATGTATCCCATGCAATTTGAGCTTATATTTGCAATGAATGC
TGATATAAGAATGTTATCATAGTAATTCCTTCTGAACATTTTTCTTTTTAACATAGATTTGCTA
ACCATTTGTATAATCAAAAATGTTATATATTGATATTTGTTCAATATTGTGAAAAATCTCTTTA
GCCATATATATTTATTAGTTTATCCATCTCATTATGATTGAAAACATTTGTGAGCTTTGCCACC
TAAACAGGGTGGCTGAAGTGTTTTACAGGATTTTAATGATTCTTTCTATTCCTTTCTCTTTAAA
TAGGTCACTTTTATTTTTAGAGGGGCAAAATGATGCTCTGCTTTGTGGCAACAGCTCAGATGC
AGGGTAAGTGATGCTTCCTACTGAGTTTCAGTCCACACTGCTCCATCAGTGTCAATAACCTGCC
ACCTCCCACTCATCCAGTCCCACTCACTCCTCACTCAAAACCCTCCATAAATTCTACTTCACGG
TGACTCTCAGAATAGCCAGGATAAGTGTAGATTCTCACCTCTTTCACACAGTCATTTACTGCAA
TTATTTTCTATGCTAGGTCACATCTAATCTTCCAAATTAGTTCAATGTAAAATAGAGAATAAA
GCAGTATAATATGCATCTGAAGCTTAATAGAATTCTTAAGCACATACTTTTATAAGTGTCATA
TTTTATATACTAATGTGTTCTCCATAGCTTAAAATGTAAGATCTCTGAAAATAATGTTAATA
TCTGAGACATGGGGAGTATTTAGCATATTTAGCAAAGTGGTTACAAACATAAACTGGAGAGTC
TGCATAGAGTCAGACTTTGACTCCATCATATAATCTCATTTCTTCTTGCCTTCGTTTCCTTATA
TGACAAATGGGTATAATAATAGGGTTTTTGTGATGATGAAGTGGATTAATAAATGTATAGCTAT
TTAGATCGCTCAATAAGTGCTTGTAATTGTTATTATTGGGATCATGCAAATGTTTGCTATTAAG
AAACATGGAGCTAAATCCTAGGAAAATTTAAAAACACAGTTAATTTTCTTTATTTAGCAAGATT
TTAGAGCCACACACAAAAGTCTAATGCACTTTCTTTGGACGATGATACTGTGGACATTAGTAGC
TAATACCTGTAGCAAAATTCCCAGTGATAATAGGCTTTCCATTTGGCTCCTACGATCAGTGCTA
TGCTGCCTTTATCTTCAGATTCCAATGATAAGTAAATCAATTGATTTTCATTCCTTGTTTGTAC
TGTACTAAATGCGTTACATACAGTATCTTCTTCAATGTTTGCAAATTTGTGAGACAGGTTCTCT
```

FIG. 6 (cont'd)

```
TATTAGCCCATTCTCACATGCGAGGTGCCTGAAGATTAGCAAGTTAAGTAACTTGCCCAAGATC
GTTCAGCTCAGAAGTGTCAGGCAAGACATTGAAGCCAGGTCTGCTTGATCTTCAAGGTCCTCCT
ATGACATTTTTACCACACAGTGTCATTCACTCCTTGCAGCATGCCCCACCTATCCTTTTCTCAC
TTCTTTACCCTGTTCCCACACTTACACACATTTCTGCCTCAAGACATCCTCAGTGAAAATCAAC
TTTTTCCTTACAGACTTTTTTAACTGCCCTTAAGTCCCAGAAGATATTAATCATGATATGATTG
CTTTTATATGGAGACATAATAAATATAATAATGACAATTATGAATCACAGAGGAATCCACAAAG
TAGACCTTATAGATTCTGTTATTATATAAATCAGTCCACTTAGTGCTGAGTTAAGTACTGGGTA
AGGTGAGAGAAATCGGCTTTTTTCTAGTGCCTGTATAAAACAGACATTGGCATATATTAAAACA
GGAAAACCAATTAGCAGACTTGCCGTTATTGACTTCCTTTCTTTCCTCTAACCTAATTATAGCC
AGTGTCCTGAAGGATACATCTGTGTGAAGGCTGGTAGAAACCCCAACTATGGCTACACGAGCTT
TGACACCTTTAGTTGGGCCTTTTTGTCCTTATTCGTCTCATGACTCAAGACTTCTGGGAAAAC
CTTATCAACTGGTGAGAACAGATAAAATCATTTTTCTGAGAATCATAAAACACCGAACTCAAG
AGAATTGCTGTAGAATATTTTATTACTTAGAGTGTAAGTTTGTAACATCCTATATAAAATTTAT
TAAAATCTCTCTTCCATTTTGCAGACACTACGTGCTGCTGGGAAACGTACATGATATTTTTG
TGCTGGTCATTTTCTTGGGCTCATTCTATCTAATAAATTTGATCTTGGCTGTGGTGGCCATGGC
CTATGAGGAACAGAATCAGGCCACATTGGAAGAGGCTGAACAGAAGGAAGCTGAATTTCAGCAG
ATGCTCGAACAGTTGAAAAAGCAACAAGAAGAAGCTCAGGTATAGTGAACAAGCATACGGTCCT
TTGTTTTTCTTTATCTAAATTCTTTAACCTAAATGTTGAGGTCAGTGGCAAGGTAGTTGACATT
AGAAATAGGTCATATGTGTTTGGTAAGTGCTAGGAGCCTGTTTGGTTATTAAGAAGTTATTACT
TTATTGCAATGATCTCTGTCAATAGTGTCAATAGTAATGGCATCAAAAAATGGATAATTATAAT
TGCTTTACTGACATTTTTTTCTCCCTTGTGACTCCTTGAGGAAATTAATGATTAACAAAGGCCT
CATGTACTCAAACTTGCAGAGTAGATAAACCTACATGTCCTCAGTTGAAGTATTTTCTTAGGGG
AAGAGGAATTCAGTTACACTTGCTTCTTCATTGCAGTATCACCAGAGGTGGTAAGGGTCAGAAA
ACCAGAATCAAACTAAGAAAATTATTTCATTGAGTCTGGAAAGGCAAAGGCTTATTCAATATTT
GTTCTCTTTTATATAAAGTGTACAAATGCAAGTTTGTGGGTTACATCAGTAAATCACTAGTGTG
TAAACATATTAAAACATTAGCACTCTCTGCCTCCTACTCTACAAATCCTTTAATTTGGACTTGA
CAAGCCTTCAAAATAAGGCAAGAATTTCTCTAATTATATTTGCTTGACTTAATGGCATTAACTA
ATCCAATTGCCTATTTTTGTCTTTTCATGTATGGTGAATACAATTCCCTTTTATTACCGAGTAT
TCCTAAATATGTAATAAAGGTCAAAGTATATTGCTGTAATAGCAACAAAACTACTGTTATACTT
TACAAGTTCATGCAGATGCCATGATCTAGGATTCTCAAATAAACACTCTGTATTATGTCTTTGC
TGTGCATTTCTTAGTGAAATACCCAATTTAAATCACGGAGAAAATGTCATTAAAATAAAATAC
TTGACTGAATTACATTTAATAATTCAGACTAGCACTAAATTTCTTTATTGTGTGAAAATGGAAT
CAAAGGCAAATGTCTACCAGGTTTAAATAGGAAGTCTTTAATTCCCATATTATTTCCTTCTTAA
AATATTGTTTGAATTATAGAACATGTTATTATGATCTTTAAGTGTCTTGCTCATATTATTAGAT
AATTAGATATCATAGTGTGAGGACAGAGCTTGAAGGTTCTCATAAAAGTCGTATGTATCATCTT
CCATATGAATGCCCATTTTACTCTTTGATTGGTCTAATAACAATGTACTGTTTCTAAAACACA
GAATAAAATGGAGAATTGTTTTTCAAGATTATCTTCATGATATTGAAGCTCAATTAAGCAGTAA
CATGATAATTACTTTTTAAGTTTATATGCAACTTCCACATACTTTGCGCCCTTCTAGGCGGCAG
CTGCAGCCGCATCTGCTGAATCAAGAGACTTCAGTGGTGCTGGTGGATAGGAGTTTTTTCAGA
GAGTTCTTCAGTAGCATCTAAGTTGAGCTCCAAAAGTGAAAAGAGCTGAAAAACAGAAGAAAG
AAAAAGAAACAGAAAGAACAGTCTGGAGAAGAAGAGAAAAATGACAGAGTCCGAAAATCGGAAT
CTGAAGACAGCATAAGAAGAAAAGGTTTCCGTTTTTCCTTGGAAGGAAGTAGGCTGACATATGA
AAAGAGATTTTCTTCTCCACACCAGGTAAAAATATTAAATTACATGAATTGTGTTCTCATAAAT
TTTTTAAAAAAATATGCCAGAATTTAATGGAGAGAAAACCGCCTTCCACCTGGATGGCACAATG
CTTTCAGAGTAGTGATGATTATCAAGTGTTTTGGCTATCACTTCAGAGAATTTGTGAGTTTTGC
```

FIG. 6 (cont'd)

```
AACTTTTTGGAATCCCAGGAAGGAAATTTTAGATCCCTCTGGGTTTGGAAAAATTTGCGGTTTT
GAGGTTTTCTTAAAGACTGAAAAATCTTGGAGAAATTTTCCACATCAGGAATTATCAGCAGATG
GTTCCCATCTCTTCTTAACTATTGTGCGTGGATCTAGTGAACTTTGGGTTTTCTGAGTGACAAA
TTCCCAGAAGTGGACCAGAGACTCTTTTAGGCCACCTGCGGGGTTGTTCCCATAAGGTGCAAAC
ATCACTTGCCAAGTGCATTCTTCATGCCTTTGTTTCAAAGGGGACTGAAACAAAATATCTCTAA
AAGTAGCCAAAACTCTCAGATAGGCAGGTACTGAGGGAGATTTATGACACGAAATAAAAAGTGG
TGTTTAGTTGTACTTGATTATCTGTGTTTCATGTTAAACATGGGACTTGCATTTGAAGAATACT
GTGATTTATAAACTGCAACAAATATTCACTGGATGCCTCTGCCTTTTGTACTCATGCAAGTTGT
TGAAATTTTAAAATTTAGAATCTTAATTGTCTTTGAAATTACCAAGAGAATTCACAGGAATACA
CAGTACCTCAGAAGACATTTTCACCAGGAGTGAAACCTTAATACCTATACAGTAACAATAACAA
TTACAACAACAACATTGATAATGGCTAATATTTATACACTGTGTTGTTATTTGCAATATTAATG
CATTAAGCCTTTCACTGCAACCCTAGGTAAGTTCTAATTTAGTTAATATCCCCAATTTTTATAT
GTGAAGAGAAGCAGGGGCTGCATTCTTTGTTGAGTACCTATTTTATGCTTGGCATTCTTTCTA
CATTCTCATAATTAATGCTAACAGTTCTGTAGAATAGTATTATTTTCATTACTATAATGAAAAA
GCTATTTTGGATCAGTAAAGTTAAATAGTTGCACAATGTCATATAGCAATAGAAAAGTTATTA
TGATCTTTGAGTGTCTTGTTCATATTAGGGTTGTTGGTATTCAAATTTTGCCTGGTACTGAAAA
CCTTAAAGTTTCCACTTTATCAAGTTGCCTATGAAGAATGCCTTTAAAAACTGATAAGGAAATT
TACAATATAACTTTATTTAAAATACACAATGGCATTATACTTTCTCTTTTACCTTTTTATAATA
TAGACAAGCTCACATAACCTCACATGTGATATATATAAATTTTTTAGGTCAGCCTTATTCATT
TCAAATCCAAATAACATCATAAGATTGCATACTTGGGGATTAATTCAAATTTAACATAGGATCT
TTAAATATCAAAATTTACTTGGTCTCTTTCATTTGTTGTCACAATCATGATTCCATTAGTAGA
AACATTAATCAATAAATAGGAATCCTTTAAAAGGCAAACCCCCTGTTTACAGTATTAGTCATTC
TGAAAAGGAAGGAAGAAAAAGAAAGGGAGGGAGGGAGGGGGAGAGAGAGAGAGAGGAAAAAAG
GGAGCAAAGGAGGGAGGAAGATAGAGTATTTTGCCTACATTTTTACCTAAGTTTGTCTGAATT
TTTGCCTGAAGTTGTCTAAGTTTTGGCCAAAATTTGCCTAAATTTTGGCCTAGATTTGAAACTT
CATATCAACTTCATATCAAACACTTACCACAGAGATTCTCTTCAATTTGCCTTATTTCTAATTG
AATAAAACTAATTCTAGGCAAAATAGTGAAGCCTGATAAGGCTAGGCTCTGTCCTTCCTTTTC
TGTACATTTTGTTCATAGATATGATATTCTCCCAGCAGCCTCTTCTTCATACCTCTACATACCT
CCATTTCCCAGCTAGTTGGGTATTATAAGCAATCACTGACTTAGAAGACATGGCATGGCTGGCT
CATATTGATACTTGTTTCTTAAGCAGTCTCTATATAAAATAGAGTTAAAGACTTTATTTTGCT
TGATAAAGAAATAGTCAAACAAATGTCTAAGAGGATGGAGAGGGAGACAGAAAAGACAGAGGG
AAAGGGAAAGAAAGAGAAAGAGAGAGGGGGGAAAGGAGAAAAGGAAGAAGAGAGGAGAGACAGA
AAACCCTGAAATCACACCAACCCCACTTGGCAAGCCCTGAAAGTAATACTGAAAATGTCAAACC
AGATAGAAGTACTTAATCTTGGTATAGCAATGGAGGGCCCATCGTGTCTGTTAGATTTTAAGA
GTTTGAGACCCCAAAATATTAGGAATTATTGTTTTGTGATGACATGATTGTGTTGGTAACCATC
TCTGTGTTTGTATTGAAAAACTATACAATGCAAGCCTTTACTGCAAGATTATAATTTCTTTAGT
AGAGTAAGTGGAAATATGAATTGTTTCTCAGACTCTGATTTGACTTGTTAGTGTGGTAAAGAGG
GGAGAAGAAAGTCAAGAATGTAATCTCTAAACAAGTTTCAAGATAATCTGGATTTTTTGAAAC
CTTTATAAGGTACAATTGACCTTAAATCATTACTTTATTATTTATTTGTGATAAGCTAGGAGTT
TAGGAGTTTTGCTTTTTAAAGATTGGTTTGGTATGGGAATATTTCTTACTGGCCATCTTTTTT
GTGTGTTACAGCATTTGATTACTATGCATTTATGTAATGAATGTCAGCAAAAGAAGTTGATGCT
AACGGATGGGGCACAATCATTTCTCATATAGCTGTCACATGTAAACTACGTTTTTGTATAGCTT
AATTCATCCATGATCCTTGAGAAACATGCAAACTTATAACTTATTTTCTTCCAACCCTTCTATG
GCTCCAGCTGAATGGGGTACTGGCAGTTAAAATATAAACTCTTACTAAAAGCGATAGAAACATT
CTTCATTGCAAAGCATGTATTGTTTGCCTTTCTTTTTTAGCTAATGAGGAGCAGTATGTCACAC
```

FIG. 6 (cont'd)

```
ATCCTGCAAATCCCGTAACTGTTATTTCCTCATAGCTAATTCGAAGTCCCTTGTTAGAGGAGAG
AAAGGAGACACGAAAAAGGATGGATAGTCTAAGAAAGGCTTTAAAAAATAACTACTTGTATGGA
AAATGATAAAAGAAAAGAATGAATGTTACTAATGTAGTTAATAGGATTAAAAAGCATGGGAACA
ACAAGAGGAGAGATGACTTCTGTTGTGGGAGCAGTAAGTCTTCTTAGAAGTAGTTCTAGGCCGG
GTGTGGTGGCTCATGCCTGTAATCCCAGCATTTTGGGAGGCCGAGACGGGCAGATCATGAGATC
AGGAGATGAGACCATCCTGGCTAACACGGTGAAACCCCATCTCTACTAAAAATACAAAAAATT
AGCCAGGCGTGGTGGCAGGTGCCTGTAGTCCCAGCTGCTCGGGAGGCTGAGGCAGGAGAATGGT
GTGAACCTGGGAGGTGGAGCTTGCAGTGAGCCGAGATCACGCCACTGCACTCCAGCCTGGGTGA
CAGAGTGAGACTCCGTCTCAAAAAATAAATAAATAAAAAAAAGAAGTGGTTCTTACTGTAAAT
AATGAATAGAATCACATAAGATAGTGTTTAACATTTACAGACATTTAATAGAAACTAACAGATA
TTATTGAGAAAAGTAATTCTTTAGCTGGAAAGAAAATAAAAAGCATACTTATTGGTCAGTGTA
TTACTCTGTTTTCATGCTGCTGATAAAGTTATACCCAAGACTGGGCAATTTGGCAAAGGAAGAG
GTTTAATTGGACTTACAGTTCCATGTGGCTGGCAAAGCCTCACAATCATGGCAGAAAGCAAAGA
GGAGCAAGCCACACCTTACATGGATGGTGGCAAGCAAAGAGAGAGTGAAAGCCAAGCAAAAGAA
GTTTCTCCCCATATAACCACCAGATCTCATGAGACCCATTCAGTACCATGAGAACAGTATGGGG
AAACCCCTACCATGATTTAACTATCTCTGACCAGGTCCCTCCCACAACAGTGGGAATTATGGG
AAATATAACTCAAGATGAGATCTGGGTGGGGACACAGAGAAATCATGTCATTCCACCCCCGGCC
CCTCCCAAATCTCATGTCCTCACATTTCAAAATGAATCATGCCTTCCCAACAGTCCCCCAAAGT
CTTAACTCATTTCAGCATTAATTCAAAAGTCCACAGTCCAAACAAAGCCTCATCGGAGACAAGG
CAAGTCCTTTCCATCTATGAGCCTGAAAAATCAAAAGCAAGTTAGTTACTTCCTAGATACAATA
GGGATACAGACATTAGCTAAATACAGCCATTCCAAATGGGAGAAATTGGCCAAAACAAAGGGGC
TACATGCCCCATGCAAGTTCAAAATCCAGCAGGGCAGTCAAATCTTAAAGCTCAAAAATGATCT
CCTTTGACTCCATGTCTCACATCCAGGTTACGCTGATGCAAGAGGTGGGTTCCCTTGGTCTTCA
GCAGCTCCACCCCTGTCACTTTGCAGGGTACAGCTTCCCTCCTGACTACTTCCATGGGCTGGCA
TTGAATGTCTGTGGCTTTTCCAGGTACACGGTTCAAGATGTTGGTGGATCTATTATTCTTGGGT
CTGGAGGACAGTGGCTCTCTTCTCACAGCTCCAGCAGGCAGTGCCCCAGTAGGGACCCTGTGTT
GGGGCTCTGACCCCACATTTCCCTTCCTCACTGCCTTGGCAGAGGTTCTCCATGAGAGCCCTGC
CCCTGCAGCAAACTTCTGCCTGTACATCCAGGTGTTTCTATACATCCTCTGAAATCTAGGCAGA
TGTTCCCAAATCCCAGTTATTGACTTCTGTGCACTGACAGGCTCAACACCATGTGGAAGCTGCC
AAGGCTTGAGGCTTGCACCCTCTGAAGCCATGGGCCTAGCTCTACATTTGCCCCTTTCAGCCAT
GGCTGGAGCCGCAGAGATACAGGGCACCAAGTTCCTAGGCTGCACACAGCGTGGGACTCTGGAC
CCGGCACATGAAACCACTTTTTCCTCCTAGGCCTCCGAGCCTGTGACGGGAGGGGCTGCTGCAA
AGATCTCTGACATGCCCTGGAGACATTTCTCCATTGTCTTGGGGATTAACATTCAGCTCCTCA
TTACTTATGCAAATTTCTACAGCCTGCTTGAATTTCTCTTCAGGAAATGGGATTTTCTTTTCTG
TCACATTGTCAGGCTGCAAATTTTCCAAACTTTTATGTTCTGCTTCCCTTATGAAACTGAATAC
CTTTAGCAGTACCTAAGTCACCACTTGAATGCTTTGCTGCTTAGAAATTTCTTCTGCCAGATAC
TCTAAATCATCTCTCCCAAGTTCAAAGTTCCACAAATCTCTAGGACAGGGCCAAAATGCCACCA
GTCTCTTTGCTAAAATATAACAAGAGTCACCTTTGCTCCATTTCCCAACAAGTTCCTCATCTCC
ATGAGAGACCACTTTAGCCTGGACCTTATTGTCCATATTGCCATCAGGCTTTTGGTCAAAGCCA
TTCAATAAGTCTCTAGAAAGTTCCAAACTTTCTCACATTTTCCTGTGTTCTTCCGAGCCCTCCA
AACTGTTCCATCCTCTGCCTGTTATCCAGTTCCAAAGCTGCTTCCACATTTTGGGTATCTTTT
CAGCAGCGTCCCACTCCTGGTATCAATTTACTGTATTAATCTGTTTTCATGCTGCTGATAAAGA
CATACCTGAGACTGGGCAATTTACCAAAGAAAGACATTTAATTGGACTTACAGTTCCATGTGGC
TGGGAAGCCTCACAATCATGGCAGAAGGCAAAGAGGAGCAAGTCACATCTTACATGGATGGTG
TCAGGCAAAGAGAGAGTGAGAGCCAAGTGAAAGGGATTTCTCCCCATAAAATCATTAGATCTCA
```

FIG. 6 (cont'd)

```
TGAGACTTATTCACTACCATGAGAACAGTATGGAGAAAACTGCCACTATGATTCAACTATTTCC
CACCATGTCCCTCCCCCAACAATGGAAATTATGGGAGATACAACTCAAGATGAGATCTGGGTGG
GGACACAGCCAAACCATATTAGTCAGGCATATAAAAACCTAGATATTAGTAGGTATAAAATAAT
GGTTTTAGTTAGTTTTGAACCTTTGGAGAGGAAAAGATCAAACCAATAATACTTAAATGATGAA
GTTAGTATTCTTTCCAATAATAATTACATAAATCCAATGCAAGCTGGCTGAAGTAAAAAAGAGA
ATGTATTAGATGATATAAATTATGTCTGTGAGTAGCTTTAGGCATGGATGGATCCAGAAGCTCA
AGACATGTTACCATGACCATGTCTTTCTCCATATCTGAATCTAGGTTCCTCCCACATGGTGGCA
AGATGTCACTGCAGCTCCAAACTTAAAGCCAATATTTTTAGCAGCCTCAAGTGAAAAGCACCA
TTTCCTCAACAGTTGTAAAAGACAGGGATATCTTTCAATTGACCAAGCAGGATTTCATGACCAT
CTTTAAATTACGTATCGAATACACTGATTGGCTAGGCCTAGGACAGTGCCTGGAACACTGGGAG
ACCCGAGCCTCAAGTCCTGCTGCATCCAGGAGTTGAAATTAGTGTCTCCCAGATAACCTGGTCT
GAGAGTTGAGGATTATTTCTCAAGGCTGAACAGGGTACTGATTTAAAAAAACAAAAAATTAAAT
GGTTGTGATCAGCCTCTTAGTGAAAATTAAGTTTTTGTAAATATTGCCCTCAGATTTCTTGAGA
CAGAGACAAAGGGGTGAAAATTGGGGAATAAATCATACAGTTATTTCAGCTTGATTTAATTTAT
TCATGAAGACCATCATAAAATATGCAAAGGGAAGTGGAGAAGCTGCCCCGTGTACTATAATTAA
ACATCCCTACTAGCAAGATTAATTATATTTCCTCCATGGTAAGATTTGCATCAGGGTGTGGTCA
CTAGCGAGCTCTTACTGGCTACATTTTGACCTCAGAGGATCTAAAGGTAGATTTGTGTTTAAT
TGTTTTCCATTGGGTTGTTAACTGAAATTAACTTCTAAAGAAGGGTCTATCAACAGTATCAGTT
CTAGATGCCCGTAACAGGACAAAACATTATGGGGACACTTCTGACTATGTTGAGGTGTGGGTAA
AGTAGGAGAAAAGAGAGCAGAAGATGGAAAATGGAGGAAGGAGAAAAGCGAGAGTGAAATAGA
AAAGGTGAACCTTGTAGAAAGTGCCAAAATGCCACCAGCAGTCATCAGAGGGGTGCTTTCTTCC
ACATGTCCAATGACTTATCCTTGAGTAAGTCAATGACTATGACACAATGAATCAAATTCTGTTT
TTCAGAATGCCAGCTCTTAACTCTCTTCATCTCATTTTGTTTCTTCTCTTGTTATTCATAGTC
CTTACTGAGCATCCGTGGCTCCCTTTTCTCTCCAAGACGCAACAGTAGGGCGAGCCTTTTCAGC
TTCAGAGGTCGAGCAAAGGACATTGGCTCTGAGAATGACTTTGCTGATGATGAGCACAGCACCT
TTGAGGACAATGACAGCCGAAGAGACTCTCTGTTCGTGCCGCACAGACATGGAGAACGGCGCCA
CAGCAATGTCAGCCAGGCCAGCCGTGCCTCCAGGGTGCTCCCCATCCTGCCCATGAATGGGAAG
ATGCATAGCGCTGTGGACTGCAATGGTGTGGTCTCCCTGGTCGGGGCCCTTCTACCCTCACAT
CTGCTGGGCAGCTCCTACCAGAGGTGAGGCCAATTAAAATTGCAGCTGATGTGAAGAGAGTTGT
GACTGGTGCAGGCAGGAGTGTTTTTCCATTTCCACATCTAAGAATTTGTTGAGTTTGTTGCCCA
AAGGCTGGGAGTTTGTTCAATCAAGCTGTTAACTGTCTTGTGAAACTGTTCTATTCAGACTTTT
CTACAAAGTAATTAAAAACCTAGGTTGGCTGTCAGAGAATATAATTAGAAGTAATCTTTCATCA
TTATTACTATGGTATGAAACTCGCCAAAAAGCAAAGCAACAATTTATCAAGCATAATGTTTGAT
TAATATAGTTAAATTAAATCCAAGGAAATTAATGCTCACTAATTAAATAAATACTTAAGGATTT
TGTGATTGTTGTTCATTTAAAAGGAGATTTGAATACTTCCACTTGCAGTAGATACTATTACTAA
ATAGATTTAAATCCCATAGTACAACATTGCCTCTCTTTGCAGGTCAGAGTGTTGTAACCTTTTT
AGCATCCACTCTAATGATCTCAACCATTGTAAATTTATACATGAAGAGCCATTCAAAAAGTACC
TGGTTTGGAATCATGGGCTGTCATTTTTAGAGCAGATTCCAATTTTTATATTACTGTCATAAAC
TCTTATTGTAAACAAAGTGGCCCAAAACCAATCACATGGAAAGGATTTCAGCTACATACTAGA
CACTTACAGGGCTATATTATTGAAATTTACTTCATAAACCATAAGAAGCTTTTAATGTTGGTAT
TAAATAAAATTCCATTAGCTATCAAGACATATTTTGGCAATGTCACTTGATTGTATTTTATAGC
ATTCAAAATGTCTTCTTATGATTTTTTTTCACATAGCTCCATTTATTATCATTGAACAAGCTC
TTTGAGCCACATTAAAATGATACGGAGTTCGTTTTCAGTTACCTAATGGAGGAGCTTCTTATCT
TGGATTATAAAATAGCCATTATCTTCTTCACATTTTTTGCATGGCCTCTCCCCACCTCCTTCTA
CCAGAGAAGTGTCCAGGTATCCTGCAGTCAGGTTGAACCATGAGAAAAGTAGAACTTTATAGTG
```

FIG. 6 (cont'd)

```
GAGGAACCAGGAAGAATGAAGAGAGGACATCAGCTCTTCTTAAAAAATGATCATAGATAACCAT
GTACCAGACACTGTCCAGAACACTGTACATGTGTTAAGAATCATTTAAGCATCATAACAACCCT
TTTTGATAGTTAGTAACATTATCCCAATTTTACAGAGGAGGAAACTGAGGCTTGTGCGTGGTGG
AGCTAAGATTTGACCCCAGGTATGCTGGTTACTGAACCTACATTCTATCAACAGTGAAATATTG
CCTCCCACTGAGTTATTTTTAATTTCTTTAAATCAAAAGAAGAGATGGTTAAGGAAATAAACA
CATAAACACTTTCATTTTAACCAATGTTTCTCAAAATATACTTCACTTTCATACTACTTACATC
AGAATCTCATGGGAGGCTTCTTAAAACTAGAGATTCCTGTGCCTACCCAGACCTTTTCAGACCA
AACCACTGAGGAGAACAAGGTCTGGGAATCTTCTTCCTTAACAAGCATCCCACATAATTCTTAT
ACATAATAAGTATGTTTATCACTGATCTTGATAAATGTTAATTGGGTAAACAAAAGCAAATCT
ACAATTACCATGCAGGAATACAGACAGACTGTCAGTCTGTCAGAAATTATTTAGCATTTATCAA
TAATTATCATAAATCTCCTGTCCTATCAGAGATGATGGGACAAATCGCTGAAGGCAAAGTTGGG
GCCAGCTTGAAGCAAAGCTTTGTGTGGTCCCTTTATTTCCTGCTTCCTCAACTTCATTCTTTAA
TCTTACAATCTTAAGTGCTTTGAGGCAGGGCACTGTACTATTGCAAAGTTGAGCTGAAGGTGCA
AACAAATGAAGTAGGCTTTTGGAGAATGCAGAGGTGAAATGACAATAGAAAATAAATAGCTATG
GGCAAATGACACCCTTGAAAGCACATCATTTCCTGTACTTTACACATAAATTCAATCGAGTAAT
GTCATTAGCAGTTTTGGAATCTATTTGAAAATTAGACAAATCTAGGTTTGTACATGTGCTTCTG
TGTAGAACAGAAGGGACTAGATGATCTTCATGTGACTATTTTTTTTTCCTTAAAACTTTGCCT
CTTTCTGACAAGCTGAAATATTTAAATTCTAAGAGGCACCCTTTGGATTAAAAGACTTTTATT
TTTAGAGATAGGTTATTTCTTTTCTTACTAATTTTACTTGTTTTTTTACCTTAAAATTAATTTT
AGAATGACCTATATGAATAGTTATCACCATTAGTGACAATCATATGCAATGAGTGGAAATTTTG
GTTTTGAATATGTATGCATTAAAATAATTCAACTTACAAAGATAAAATACTGCTAATTGTTCA
CATCATAATAGGATGTGACCAAAATAAATAATATTTTGATCATATTATTATATTTTGATCATAT
TGTTCTTTTAGAAATAGGGAAAGTCCTCAAAGGAATGAAACTTTTTAATTTATTATTAACACTC
AGACCTGCATTTGAAATTCTTTAGCTTTACCTTTTTTTTCCTGTGATAATTGACATCATTGTT
TGATCTCCTGAAGTAGGAATAAATTTCCACCCATGTTGAAATCCTGATGAGTTTATTCTGGAGT
AGGAGATTATCAGATCATTGTATCATTACTAAAAATCACAGTCCCCACATTGGTATTATCTCC
TTAAATTATAGTCTCAGTGCCAAGGGTGGATTGTTTGTGGATTAAGTTGTTTTCAAATATAG
GACAAAGTTATAGACTAGTTCTAAAATTTAGTTTTGTAATTAGGAATGTTGGGAAATATTACCT
GTGTCTAATGAATGAAGGCATTTTGCAACTGGAATTCACATTTTAGGGGAACTGTTACTGATGC
ATATGAAGGAGACTTTCAAACCTTTTGTTCATATATTAAACTACCTGAATATATGTCTATAAA
GATCTAAAAACTCAACCTGGGTGAAAATTAAGAAACAATATGTTTTGGTCTGAAGTCCTAAGTG
GGATTGGCTGAAATGCTAAAAGGTTATCTGTCCAGTAGTGGACCTGGTCCCTCCAGCCCAAATC
CCTGGGATAGAGGCATAGGAAAGCCCACCTTGACAAACCCAGGGCTCCCCAAAAGCTGAAAATC
TGACAGACTTTTAAACAACCCCCAAAGAATTATCATTCCAACAATATCTTAGTGAGCTTTTTAC
ATCTGAGAAAGCATGGTGTATATTTAGTTAAATAACACCTGTTGTAGGAATGCTTTGGGCTTTG
CTGCTTTCAAAAATAGTGGTTATTTCATCTGAAATTCTACTTCTAGGGCACAACTACTGAAACA
GAAATAAGAAAGAGACGGTCCAGTTCTTATCATGTTTCCATGGATTATTGGAAGATCCTACAT
CAAGGCAAAGAGCAATGAGTATAGCCAGTATTTTGACCAACACCATGGAAGGTATGTTAAAAGT
CCTGCGTCACAGTTACTTGGTGCTTTGGTAATGATGAAAAAACACTTCATAAATTTCAATAAAA
TACTTCCTGACTTGATATTGTATCATTATTACACATTTTACTAAATAACAGTAAAATCCGTGCA
TAACTCATGGATTCTATTATCTTCCACAGATTTTTTTTTTTATATTTAGCCTCCAGAAAGCTG
CTGCAAATGTAAGGTATATTTTGAACACCACTTTCATACATTAAATTCTAAACATTGAAACTTG
TGTGCATGACGTTGAAAAGAGTGTAATGATAAATGCTTATACTTATGATGATGCTAAGCCATTT
GGATTATATTAACTGCTTGAGACACAAGTTATAAAATCCTATGACTTAACCAGAAATATAAATT
AAAAATGTGAATTAGGGTTTGATATTAACTTCCTTGAAGCAAAGTGTTTAAAATTTTGTAGTCC
```

FIG. 6 (cont'd)

```
TACTTTTGCCTTTCTCTGACCAGATTCTTACAATATATCAGCTTTCTCTTTAGTTGCAGATTTT
ATCTGAATAGTTAACATAATGTGTAGCAGTCTGGATCTCAGAATGCCAAAATAAAGACTTTGGG
GACAGCTTAATCTGTGATCAATTTCTGGCTCTGCCATATGTTAAATGTGTTAATTTGTGACTTT
GAATTCAGTCTCCTCATCAGTAAAATGTGGATGATGATGTTAGGCATAAGGTTGTTGAATGG
ATTAAATAAGCCTTCTTAGATAAAACACTGATGTATTTGGCATGCAGAAGACAGTTAATAAATA
TTATCAATATTAGTTGTTTTGTTGTTGTTATTTTTGTTAATTCACATGTTTTGCCTTTCCATA
CTGTAAGTGAATTCAAACAACTGTCAACTTCAACTACTTGGAAAATATTTTCATGTAAAATGTA
TTCTATCCCCCTTCCTTGCCCTCCTATTCCCTCCTCTCCCTATCTCTTTACAAACCTTCTCCCT
TGTACCCCTTCCCAGGTATGTGTGTGAGTGTGAGTGTGTGTAGATGTGTCAAGGGAGAAGAGAA
AAGGAGAATGAAAGCAAAGAGAGCAAGCATACACGTCCCTTTCTTATTGATAATTAGATTTTC
TCTTGAGATTGGATAGATTCCTGGAATAATTCTTTTCCTGTCTGTATGCAAAGATCCCATAATA
TTATTAATACCAATACGAAAAGCCTGAAAATCACAGCCAGAAAAAATTCACAGTGTAGACGACT
GTGTACATCACAGACAAGTCAGTATTACAAAACCCAATTTTCATAGTGTCCTATTTCAGTATCC
TAATGCAATTCACTGATTTCAATTGAATATTAAACTCTAGTACGTTCTTCCCCAACCTCGCCTG
CGTTAGCTTGCACTCCCTCTTCCCCCAGCTGCCAGTAGCTTGCTCCTCCCTGTCCCTCCAGGT
AAATCTTTTGAAGATTGTCTGGCCTTCCGCTCCTTGCCATAGCAAAACCACTGAGAGGAAGCTG
CCAGTGGTTCTGCTACCGATGTCAGCAGCATGTCTGCTCCCTAAAGCAGGAAGTAGAGAAGGAG
ACAGGGTAAGTCTAAATCAACAGTCATGCTTTGCACTTCTGATAGCATTAAGTTTGAGCTAAAT
AAGACATTACTTAAAAAACCTCAAATATCCACAAGATTGGACTTGCCAACTAATTAAGATTTGG
AGTTCAAAATAAATGCACCCACACCTTTCTCCATGGAACTATGTGACATGGGGTTGCTTAGGAT
GGAAAGGATGTTCTAGGAATAAGTGCAATCTAGGAAGCTGAAGACTGAGAGTGTTTCGTTTTA
TTATCTGCAGAGCTTTTGACTTGTGTATTTGTGAGAAATAATGGCCAAGTTTTTATTCTGTTTT
TAATCAGTTATCTAGAATGAAAACTGACTTTTCTTTATTCAATTGTATGTAGACACATTGAGTG
TGACATTTGTCAAGGTTGGTTGTTAGCAATATCACATACATGCATACTCAAGCAGACTTAAGAT
AGTCCTTTTTTTTTTTTTTTTTTTTGGTTTCTGATAATGGTGCAAAGTTTTCCTGGTTGAC
ATAATCTCTTTTCTTGGGGATCCTTTCTTCTATGTCTGATTATTGTTTATTTCACCTTTCCTTT
TTATGAACCAGGCTTGTTGATCCGGTTGGCAATTTTGTTCTCCTTCTTTTAACTACAGCCAA
GTCTCCGTTGTCCAGGGTAATGGATAGCCTCATGCTTAATGAAGCAGTAGTGGATAAGCAAAAA
TGAACCATTTGCGTTTCAAATTTTTAAAAGTGCAAAATCACATAGAAATGTTTTCTGGTCACAC
CTTTGTGAAGGATGGTGGGAGGGTGAGTTAGAAGCGCCTGAAGAATCAAGGTGAGCCAGCAAAA
GACACAGATTTACTGTAAGTGATTCTATGTGGATAACCCATGCAGGAATAATGGAGATGTGGCT
GCAGTTCTCTCCTGAATGCTTTGCTTTGTTTTAAAGTGTGAGATTCCCCCCTTTTTTTTGGAAT
GAATAATTGAATGATTTTATTTTAGAACTTAAACAACTTTGCTCCGGTTATTCCTACTGTCAAG
ATGAGCCACACCTGCTGAATTTCATTTTTTAAACTTTTCTCCAGTTTATTTTTTTCTATCCAG
TTCCTGTTTGCTTCTCGTTATTTGCTAAATGACAGCTGGCATGGAAAGAAAAAACCATATTATG
GCAGTATACAGACAAAATTAAATTTTGTAGTTTCTTTTTTGTTATTTACTGTAAATAATAATAC
CTCCTTTTTACCTTCAATGTAAATATAAGGTTATTTGGGAGTTTAGAAGTATTTACAAAATAAC
TAGTGCATAATAACTATATTTTTCTCTGAATTATAAATCAAATATTATTTATTGTTTACAAAGT
TATGTATTAAGGGAAATGGAAACAAACTGGGCACTTGAAGAATTTCAATATCCAAAGAGACAAT
TGACAAATCTATTTTTAGTGGAAATTTTAAAAACAATAAGCAATAAATTAATTTACTTAGGAAA
ATAGTATTATAGAATTAATTAGTGGCAAATGTTGATTAGTAGAAGAAACATTATCATCTGTGGT
TGTGATTGTCCTTTTATATGCTGGTTCCACCTTTACAAGGTTTAGTTCATAGCAAACTGTGCCA
GATATGGACAGATGTTCCAGTTGCCACAATAGTATTAAAGTGACTGACTAGAGTCAACTATGCC
ATGGATTTAAAAGAAGAAACCTTCCCTCTATTTCAGTGCTAAGAGGTGGTGGCCACATTTTGG
CAGAACAGGTAATAGGGTGTACAGCAATGATATTGACAGAAAACAACAAATTCTGCATATTTTT
```

FIG. 6 (cont'd)

```
CCACTCATAAGTTGATGAAGAGATTATCTTGCCAAAGGAAGATGGTAGACAGTTTTTCACTTCC
TAATTCCCCAAATTTCTTTGCCAATATTCACCAAATTTCAGTATTTTGGGTGTGACCTTAAAGA
TCTGTGCATTTCTGTCTTCTCTCCAATGTTTGGTTGAAATTCTTCTTGACATCATTGTACATT
TTCCTTGAATAAATGCATTTAATATAAAATTTATGTCATGTTTGATATGAGAGTTATATATT
TAAATACATTTAAATAAATGTTTACCATGAAAATGTATGAATTATATGTATGTTTCACCTAAAA
TCCTTTGTATTTTTCCAGTAATAAATGAGTTCCACTTTGTGAAATGTTGATTTGTAACAACAGT
GAGGACTCCAGTTCCTTAGGCTGGGGTATTTTCTCTTCTTTTATGCCCTCTAGTTAAATGAGAA
ATGTAGAGATGGAACTTTGTTGTGTCTAATATGCAAGCCTATAATCTAATAAAATTTAATTT
GAGACTTTTAAACTGAGATTGGTGACACTGACAAAATTATCTAATTAGAAGATCACCAAAACAT
ATCTAATCCAAGAAACTGACATTCAGTGTGACTGATTAAGGTTCTTAGGACATCTCCTGAGATA
TCTCTGATAACATATATACTTCTTGCTCTACCTGGAACATGGATGAGCTTTAAGTGTATGCAAT
GCAAGTTCTACCCATTAGTTTCTAGCAGCCTTGAAGATAAGTATCAGACAGTTTAGTGTTGCCA
ATAGAATCTTGGAAGCTATGTTTAGCCAGGATACATTTGGAAAGCTTACTAGCCTTTCTGTACT
GATCCTTTCTATGACAGCAAACCCATTGTAAAATTTTCCCTGTTCCTCCAGCAGATTAACCCAT
AATATCTTTTAACAACTTTAGATTTTTTAAATTCCTTTTAATTTAAACCAAATCTGCTTAATAG
AAAGTAAGCAGTTTTCATGAGGATTCTAACTTTTTTTCTTCCAGAACTTGAAGAATCCAGACAG
AAATGCCCACCATGCTGGTATAAATTGCTAATATGTGTTTGATTTGGGACTGTTGTAAACCAT
GGTTAAGGTGAAACACCTTGTCAACCTGGTTGTAATGGACCCATTTGTTGACCTGGCCATCAC
CATCTGCATTGTCTTAAATACACTCTTCATGGCTATGGAGCACTATCCCATGACGGAGCAGTTC
AGCAGTGTACTGTCTGTTGGAAACCTGGTAAGCCTCACTGAGAGTTTCTCTTCCTCTTGAAAGA
GTTTATAATTGCCTTAGTGAATTTTACATATTGCTCTCAAATTAAATATCAACTAATTGGCCAT
GTATATCTTGACATCAAATGTTTAGCATCCCTTTTAAATAACAAAAAAATGTTGCTACCATAGT
GCAAAAGAGTCAAAGAATTTATGTACAATTTGATTTAGAATTGAATTTAAATTGCTTATTTATT
AGAAGATGATTCTGAATTGTCCTCCAAGGACATTGATCTATAGCAAAATTCTGACATATTTTA
AGAACCTTAGAATAGGTTCTTTAGGACATGTCTGTGTTTACTAAACAAATGATAAAATATGCCC
AAGTCAGATAATTTTGAAATATCACTTGTAAGTACTTGAAGATGGACTATGTAGGGAGGGGACA
TCATCTGGGGGATTATTATTTTTGTTTTGTTTCTTCTACAGTCTTAGCAATATTAAATTTAG
AAATTATTTATTTAATTTTGTTAAAATATATATTAGCATTTACTGGATACATATTGATATTATA
ATATAGTATACTATAGTGATAGATTTTAAAGTGGTCTTATACAGAGAGACAAAATGAAGAAAAT
CACGCAAAAAGTATATTTATACAAGTATAAAATGCTTATTAAGTTCCCAGCTTGATAAATGAA
CATATAAGCAGGTTATATAGAGATTGTAAATAATACGGTCTAAAGTATAATATACAATATTTTT
AGGCTCTGAAGTAACCACTATATTTTCGAATTATATTTCAGGTAGGACTTAACTGAATTAAATG
ATAAAGTTGGCATATGTTGGCCTCTTATTTTGTATCAGATATTGGACTAAATGGTTTACATTAA
ATCTCTCTCTAGATTCCCACAAAACCAGTCTTAAGATATTTACTATAAATTGTCTGTATTTC
GCAGTTGGGAAACTGTATCCATGAGAAATTAACAGAGAAATGGAAGGTCTGAATGCTGTATCAG
ACTCTGAAAGCTATTTCAGAGACTATCATAAGCTATGGGCAAAGATCACAGACGCTTAGAGTAG
GAAAGGATAATAATTTTACCTAGTTCAAATTTAGAGCTATGTAAGAATTTCTTCAACATTATTT
CTAAAAAAAGCAGGGTGGTGGGTGGCAATTGAAACAAGAAAGCCTTTGGAGGTAATATATTG
TGATCCAAATTGAATGAGCTTAAGCAAAAATAAAGGGAATTCATTACCTCACTTTACTGAAGCC
CATTTGGAACTAGTTCTAGGTTCTAACCTGGCTAGATTCAGGTTCTCAGCCAGCATCATTGGGA
ATCAGCTTCTTGTCTCTCTTCTTCCCAATATGTGACCTTCCTCTCTGGCTGGGCATTTTCCTAC
TATTGCCAAGATTCTATCAACTTTTATTCTACTAATGTAGCTCCATGTACAGAAAGTTTGTGCC
TCCTAACTAGTAGCTTTAATTAAGGCCCACAAATTGAATATCATTGACCTGGTTGGAGTTACAT
GGCCATTTCTAAACCAGTCAGTTACCCTAGCTCTTGGTTTTAATGCCATATTCGCCTAAATCAG
AATCATATCTTATCACTGGAGGCAGAGTAAATGAGTGAAATTATGAAGACAATAATTAGGATAC
```

FIG. 6 (cont'd)

```
CATTACCAGAAGGAGGATGGATTCTAGAAAGAAATAAACAATAAATAGACAACTCAAGCTGGGG
CTGGTCTTACGTGTTAAGGAATGTAGGATCTGTATCTAAGGTGAATTATGGAATAGTAGAAAAT
CCATAGGCAGGATACACATTCTTCTCAAATGCCTATAGGATATTCCCTAGGATAAGTTATAGGT
TAGGTCATAAAACACACATCAATAAACTTAAAAAAATTAAAATAATACAGAATATTTTCTGAT
AAAAATAAAATGAAATTAGAAACCAATAACAAGTCAATGTGGAAAATCACAAATATTTGGAAA
TTAAACAACTTGCTCTTAAATAACCAATGAGTCAATAAGATGTCATGAGAGAAATTAGAAAATA
CTTTAGGATGACTGAAAATCAAAACAAACCAAACTGAAATTAATGAGGGCAGCTAAAACAATAT
TTAAAGACAAATTTATACTCTAAATGTCTATAGTAAATAGGAGATTTCCCAAATTGCTAATTT
AAGCTCCTTTTTAATAAACTAGATAAAGAATAGCAAATTAAACCTGAAGTTAACAGAAAAGACA
AATATTAAAGAAGAGAAAAACAACAGAGAAAATCAATAAAACCAAAAGTTATTTCTTTGAAAA
AATCAACACAATTGACAAATCTTTAGTTGGGCTAACCAAGAAAAAAGAGGAAAGACACTAATT
ATTAGAAGTAGGAATGAAGAGAGGATATTACCATGGATCTTTTAGAAAGAAAAAGGGAGCATAA
GAAATAAAATAAAATTAAACGCCAGCAAACTAGATAACCTATGTGAATTGAAAAATTCCTAGG
GAGTAACAAGCGCCTGAAACTGACTCAAGAAGTAATAGACTATCTCAATATACTTATAATAAGT
AAACATTGAATTCACAATTAAAAAAAGAAACTTCCTGCCAAAAAAGCCTGAGCCCAGATAG
TATCACTGGTGAATTTTGCCAAATGTTCAATGGAGCGTTAACATCAATCCTTAACAAACTGTTC
CAACACATAGAAGAGAAGGGAATACTTCTCACCTCACTTTCTGAAGCTAGAATTACCCTGATAT
TAATGCCAGACAAAAATAATGCAAGAAAAGAACACAGACACAAATATAGACCAGCCATATCCCA
TATGAACATAGGCACAACAATCCTCAACAAAATACTAGAAGCCAAATCACATAACATATTTAGA
TTTTTAGATTATGTACTCTGAATAAGTGAAATTTATCCCAGTGATGCAGGGCTGGACCAGCATA
AAAAATTAATGTAATATATCATATTAATTTTAAAAAACTATACAATCATCTCTATAGATGCTGT
AATCACATGGAAAAAGCCAAAGTGTTTCATGATAAAAACACTCAGCAAACTTGAAATAGAAAAG
AACTTCAGCCTGATAAACACCATCTCAAAAGACCCCACACCTATCATCATTCTTAATAGTTACT
TTAGATGCTTTTATCTTCAGGTCAAGAAGAAGGCAAGGATATTTGCTCTTGCTACTTCTTTTCA
ATATTGTACTGAAAGTTCTAACCAGGGAAATAAGACAAGAAAAAGAAATTAATGGCATCTAGAT
TGGAACACAAGAAGTAAATTCTATTAACGAATACATAATCTTGTATTTAGAAAATCCTATAAAA
TACACACACACACACAGCTGTTAGAACTAATAAATAAGATTGCAGAATACAAGATCAATA
TACAAAACTCAATTATATTTCTAAACACTACTAATGAACAATCAGAAAATAAAATTAGGAAAAT
TCTATTTATAACAACATGAAAAATAATAAAATACTTAGGAATAAATTTAATAAAATAAGTGTGA
GATTTGTACACTCAAAGCTATAAAATATTGTTGAAAGAAATTAAAGAACTACTAAATAAATGAA
AGCACATTTTATATTCATAGATTAGAGGAAAATATTGTTAAGATGGCAATACTCACCAAATTAA
TCTACAAATTTAACGCTATTCATATCAAAATCCCAGCTACCTATTTTGCAGAAAGTGATAAATT
GACTGTAAATTTTATATGAAAATGCAAGAGACTATATGCCACACAATCTTAACTAGAAAAAAA
TAAAGTTGGAGAACTCAAACTTCCAAATTTTAAAACTTACTACAAAGCAAAAGTAAGCAAGATA
GTTTGGTACTGGCATAAGGATAGCTATATACATCAATGGAATAAAATTGAATTCCAACAGTAA
GTCTTCATATTTATGTTAAATTAATTTTCAACAAGACCACTAGACAATTTTATTAAGGAAAGAA
GCCTTTTCAACAAATGGTGCTTGGACAAGTGAATATCCACATATGAAAGAATGGAATTGAACCC
TTACTTAATAACATATATAAAATTAAGATAGGTCATAGGCCTAAAGGTAGAGCTAAAACTATG
AACTGTTAGAAGGAAATTTAGAAGTAAATCTTCATGACCTATTATTAAGCAATGATTTCTTAGA
TATGATACCAAAAGCACACACAATAGCAATAAGAAAAAAAGGTTCATTGGACTTTATCAAAAT
TAGAAACTTTCATACTGCAAACAATATCATCAAGTAAAAGACAACTTAAAGAATGGAAGAAGA
CATTTGCAACCCAGATATCTGATCATGATTTGTATCTAATATATGTAAAGGATTATTATAACTC
CACAACAAATAAAATAGATAACTCACTAAAAATGATCAAAATATTTGAATAGACATATTGAAAA
AGGAGTTAGACAAAAGGCCAATAAGCACATAAAAGATGGTCAGCGTCACTGGCTAATTTTAGGG
GAAAGGCAAATCAAAACTAAAATGAGATACCACTTCACACACACTAAGATGGCTATAATCAGAA
```

FIG. 6 (cont'd)

```
AGAAAGCCAATACCATTTTTTATCAAGGATGTGGAAAAATTAGAATGGTTATGCTTTACTTTGA
GAATATAAAATGATGCAGTCACTTTGGATAATAATTTAGCTGTTCCCCAAAAAGTTTGGGGTAG
AGTTACCACATGACCTGGCAGTTTTACTAATTTCTTCGGATATATATCTAAGAGAATTAAAA
ACATATTTCAACATGAATGCTTATAGAATATTATTCATAATACTAAAAATTAAAAACAATTCAA
ATGTCTATCACTTGATGAATGGATAAACAATATCCATCCAATAAATGTTATTCATCCATAAAAA
AGAATGAAGTATTGCTACAATCTACAACATGAATAAACCTTGAATATATTATATTAAGTGAACA
AAGCCAGTCACAAAATTTACATATCATATTGCTACATTTATATGAAATGTTCATAACAGGCAAA
TCCATAGAGACAGAAGGAGATGAGTGGTTGCCAGGCAGTAGGGATTAGGGTAAATGGGAGCAA
CAACTAACTAATGGGTATGCAGCTTCTTTTTAAGGCGATGAAAATGTTCTAAAATTCAATAATG
GTGATGATTTTACAAGTCTGTGAATATATTACAAGCCACTGAATTGCATACTAATATTTCATAG
TATGCATGTATCACTATTTTTCTTCCAATCACCTATTGATGGATGTTCAAGTTGATTCCAGAT
ACTTTACCCCCATGTTGCAGTAAATGTTCTTGTATATATCACCTTTCATAATGCTGTATTAACT
TCTAGAAGATAGATTTCCAGGATTGAAGTATTCCCAATATTAAACATATTCATGTCACATAAAA
ATTAGATGATATGCAACGAAATAGGGAAATGTGACTCATAGTTAATAGATTAAAGCGGTACATA
GAAATAGATCTGGACAGGAACAAATTGTTAGAATAAACAAAAAGGACTTTGGAGGCACTATTG
TAAATATGTTGAGCAATTTAAAGGAAAAAAGGGGTCATAAGGAATAAACAGAGAACATGAGCA
GAAAAAATGAAAACTGTAAAAGGAATAACTCAGACATTTATAATTGAAAGTACACATTCT
AATATGAAAAATTCACTGGATGTGTTTAAAACAAAATTGCAGATGTCAGAAGAAATAGTTGTTA
ACTTGGAGCACATTAATAGAAATTATCCAATTTGAACACTAGAGAATTAAAAGGAAAAATGAAC
TGAGTCTAACTATAATATGGGATAATATCAAGTAGTCTAAATATTTATATAATGGGAGAATCAG
AAGGAGAAAATAGAAAGAATGGAACAGAGCAAATATTTGAAGAAACAATGGCCAAAAATTTCCC
AAAGTTGGTGAAAAATAGTAACTTACAGACCTTAATGTTACCTTATAAAATGTTAGTGAACATC
AACAGGATAAATATAAAGTAAGCCATACTTAGGCACATCTTAGTCATGCTGCTGAAAACAACAA
TAACAAAAGCTTTGGAAACAACCGGAAGAAAATATTTACTATATCATGAGACTAATGTCTT
ACCAGAAATAATTCAGGCCAGAAGAAAGTGGCCAGATAAAATAAAGAAATAAAAGCCCATTATT
CTACAGAAAGTGAAACTATCCATCAGAAATTAAAATGAAATAAAGAATTTTAAGATAAACAAAA
ACCTAAAAAAGCTGTTACCACCAGAACTACACTACAAGAAATGTTAATGGAAGTTCTTTAGGCC
GAATAGGAAAAATATCAGATGGAAATTTGTTTCTGGGAATGATGGTCACTAGATATGAATAAAT
GTGGGTAAATACGAAAGACTATCTTTTTTTCCTTAATTTTTTTCACATTTATTTTAGGTTCAGG
GGTATGTAGACAGCTTTGTTGCATAAATAAATTGTAAATCACAGGGGTTTGGCATACAGATTAT
TTCATCATCCAGGTAATAAGCATAGTACTCTATAGATAGTTCTTCAATTCTCATCCTCCTTCCA
CCCTCCACCCTCAAGTGTCTGTTGTTCCCTTCTTTGTGTTCCTGTGAACTCAATGTTTAGTTCC
CACTTATAAGTGAGAACATGCAGTATTTGGTTTTCTGTTGCTGTGGTAAATTTTTAAAAAGAC
AACTGATTGTTTAAAGTGGGGATTTATAACATAGGTAAGTGTAAAATTATGAAAAGATTTGAAC
TTTTTTTTTTTTTTTTGAGACGGAGTCTCGCTCTCTCGCCCAGGCTGGAGTGCAGTGGTGCGAT
CTCGGCTCACTGCAAGCTCCGCCTCCCCGGTTCACGTTGTTCTGCTGCCTTAGCCTCCCGAGTA
GCTGGGACTACATGCACCAGCCACCAAGCCTGGCTAATTTTGTTGCATTTTAGTAGAGACGGG
GTTTCATCGTGTTAGCCAGGATGGTCTTGATCTCCTGACCTCATGATCCGCCCGTCTCGGCCTC
CCAAAGTGCTGGGATTACAGGCATGAGCCACCACGCCGGGCCAGAACATTTTATCTAAAGTGTT
ACAATATTAATTTTACATAGAAAATTACAAGAAAGTATCCCTCATGAACACAGAAGCAAAAAAT
CATTAGCAAAATATTATCAATAAAATCTAGCAATAGAGAAAAAGTAATAAATACTTCTTAAAC
ATGTGGGGATTATCTCAGAAAAGTAAGATTCATTTAACATTTGAAAGTGATCAATTAATTGGC
CATATTACCTCTAAAAGAATAAAGGAAAGCCTAAGATCATCTCAATAGATGCAGAAAAGGATCT
GACAAAACTCAACAGTCATTTGTGAGAAAACTGTCAGTAAACTAGGAATAGAAAGTAGCTATC
TCAAGTTGTTAAGGACGTTTCAGAAAACCCTACATCTAGCCGGGCGTGGAGGCTCACGCCTGTA
```

FIG. 6 (cont'd)

```
ATCCCAGCACTTTGTGAGGCTGAGGCAGTGGATCACTTGAGGTCAGGAGTTCGAGACCAGCCTG
GCCAACATAGTGAAACCCCGTCTGTACTAAAAATAGAAAAAATTAGCTGAGCGTGGTGGCAGGC
GCCTGCAATACCAGCTAACAGGGAGGCTGAGGCAGGAGAATTGCTTGAACCCGGGAGGCGGAGG
TTGCAGTGAGCCGAGATTAAGCCACTGCACTCCACACTTCAGCCTGGGCAACAAGAGTGAAACT
CTGTCTCAAAAAAAAAAAAAGAAAAAGAAAGAAAACCCTACACCTAATATTTTACTTATCAGTG
AAATGTTGAGGTAGTGAATTCTTGCCCCTTAGAAAAATTGAGTGCTTTCCCCTTAACATAGACA
ATATGTCTATTTTTACCATTTTTATTTGACCTTGCACTGGAAGTTTTATCAACTGAACTAAAG
GAAAAAAAACAAAACAAATAAAATGCATAAATATTGAAATGTGGTAAATTATCTATTTCATCA
ACATGATCATATTGTAGACAATCCTAATAAATCTTTAAAACTGATTAGAAATAAACGCGATATT
AAATATTTTATTTACCATAATATCAAAAACACGAAGAATATAGTAATAAATTTAACAAATCAT
TTCGAGACACCTATTACTAAAAACCTCAAAACATGGCTGAGAATAATTACAGAAGATTTAAACA
AATGGAAATATATATGCCATGTTCATGCAATGGAAGATTCAATATTATTAAGAAATTAATTCTA
CCCAAATGTATCTATCAATTCAACCCAATCCCAGTAAAAATGTCACAGATTTTCTTTGTAGAAA
TTGATGAACTGACTTTCTATGCAAATACACAGTGCTTAAAATTGCCAAAACAATACTGATAAAA
GAATAATGAAAACATTAACCTACCTGACTTCAAGGCTTGTTATAAAGCTGTACTAATCAAGAAT
CTACAGTATTGGCATAAACAAAGATATCAATGGAACATAATGCTGAGTTCATAAATAGATCCAA
ACTACATGTCAATGGATTTTTGAAATAAACACTACAGAAAGGAAATAGAAGAAAGGAAGTGTT
TTCAACAAAATATCAGGAACACATAAATAAATGTATGGAAAATAAATGAACCTCCACTTCGATC
TTATGCCAAGTGCCAGAATCAATAAGGATTGTAGACTAAGCAGAAAAGCTAAATCAATAAAACA
TCTGAAATAAAACACAGGAGAACATCTTTGAGACCTTGGGGTAGGCAAAAATTTATTGGAAAAC
AGACAAAAAGTGCTATCTATTATTTAAATGTCCATGAAATTTCAAACAATGGAGACCTACTGAA
CAAAAAAGAAAAGTCTAGTAATATACACATGGGTGAATTTCAATTTGAAGTATTCAAGTAATAT
TTGGAAAAGTCACTAAGACTGTCAGGTCTCTGAGGTAACCACCTAGGTAGAGAGAGATTCCATT
TACTGAGTTAGCAAATATCAGAAGAGAAGCAAAACTGTGGAGAAAAAGCAGTAAGATGAATTTT
GGACCTGTTGAATTTGAGATGCCTGGGAGATAGTCTTTCAAATGTAGGTATTGAATAGGCAGGT
GGGTATGTATTTCTAGAGACTAGGAGGTATGCTTGAACAGAAAAATAGATTTTGAAATATGAAC
TATTATAAAAATGTAACTTATTATAAAAGGAAAACTAAAGTAAGAGGGGTCTAGACAGAGAGAG
TTCTGAATAAATCCAGTATCAAATGATTTGTTAGAGGAAGAAAATCAGGTGAGTAGCATCCAGG
GAGGTGTGGATCACAGAAGCTAAGGGCAGAAAATATTTCAATGAACAAGGAACAGAAAACAATG
CCTGAAACTTCTAAAAGGGCAAGCAAGCAAGATAATTGTTTAAAAAATTTCGTTTGGATTTATT
GGTGATGTCGGTCTTGTTGGTGAAGTTTGTTAAAGCCATTTGGTGGGTTGTGGAGTAAGGTGAA
GAAATGGAACTGGCAAGTGTAGACAAGTATGCAATCTTCGAAAGAAATCTGGCCATAAGGAAAG
GATAGATGGTGGCACCTGGAAGGGGAAATAGAGTGCAAGGAGAGTTTCTCTTATGACAGTGGTG
ATATATATATTTTTGTTTGTTTGTTTGTTTTTGAGACGGAGTCTTGCTCTTTCGCCCAGGCT
GGAGTGCAGTGGCGCTATCTCGGCTCACTGCAAGCTCCGACTCCCGGGTTCATGCCATTCTCCT
GCCTCAGCCTCCCGAGTAGCTAAGACTACAGGCGCCCGCCACCGCGCCCGGCTAATTTTTTGTA
TTTTTAGTAGAGAAGAGGTTTCACCGTGTTAGCCAGGATAGTCTCGATCTCCTGACCTCGTGAT
CTGCCCACCTCGGCCTCCCAAAGTGCTGGGATTACAGGCGTGAGCCACCGCGCCCGGCCCACAG
TGGTGATATTTTAAGGGAGAGAAGGACTCGGTAACTGTTACTTTCTATAAAGAAACGGGAAGT
AGCCAGTAGTAGAAATGTTGGTTAATTGAGAATGAATTCCTTGCAAAGTCCAAAGGAAAACACA
TAACACAATTTGAGAGATTAGCTCAAAACAGGGGCACTTCTTTCATTTTAACAAGAAGAGAAAG
GCAAAGCACAGTTACGGATGTAAGTAGTCTAGTAGATAAAGGGAAACAAAGTTCAGGCTGGCTG
ACTTTCATCACCTCTAAGACGCTGAAGTACTGAGACTGTGCTTCTCAGATGGGAAGGCATAAGC
AAAAATGGCTGAGGTTATGTGCAGAAGAGAAAGTTTGAAATAGTTTTAGATAATAGAAATGGAG
AAAGGAAAATACTGCTTCCCTTTCGCCAACAAAAGGAAATTTTTTTAAGAGTTCTTACTATCTG
```

FIG. 6 (cont'd)

```
TAGAGCTAGCCGTGAGCATGTTTATTACAGCTTACATGACATCTTAGCACCAGTCTCATCTGCA
GGGCCAAGGGAGGGGACCAATCCATTTGGCTTGGTGATGGAAGCCCGCACTGCTAGGTAATCAT
TTGGTAAGTTTTTGGAGGGCTAGAAAGATCAGAGACAGAGCCAAACAGTTGATCACAATGAGTC
AGTTGCACCTTTCATATGAAAATAATATTAATTTTATTGACTTAATCCGTGTACTCTTTATCAT
TTGATAAACATTATATATAGTGAACAATTATTGATTTGAATGCAAAGCATTTGTAGATACTAAG
TTGTTGGACCTAAACCAATTTTTTAAAATCAGAATTTAATTTATATTTGTTGGGAGTAAATTAA
GTTGCTCAATAATTATTCGTGTTTCAAGAGTATTTGCTCATATAATGAACTACACTTCTCATTT
AGGTCTTCACAGGGATCTTCACAGCAGAAATGTTTCTCAAGATAATTGCCATGGATCCATATTA
TTACTTTCAAGAAGGCTGGAATATTTTTGATGGTTTTATTGTGAGCCTTAGTTTAATGGAACTT
GGTTTGGCAAATGTGGAAGGATTGTCAGTTCTCCGATCATTCCGGCTGGTAAATTAACTGGGAG
TGTTCATAAAATGTACTTTGTAATTAATTAGTCTTCATTCTCATCTAGTAAAAATGGCAAGATT
TCCCATCATTATAATATTATTTGAATACACTTCTAAAACAAATTGGATTGCCATACCACCAAAT
GGTAGTTTCTTCTTCATCATAGCTTTAATAAAGTTCACTTAAATGAATAGTCTACACTTCTCTT
CTTAGTTATTGAATGGAAGGCTAATAGAGAGGAGGAAACAGGGAGTCACAGATAAACTCGAATC
ACAATTAAACAACACCATAGTCAACTCTCAGTTATCTGAGGTTTGCATAACTGCGTACAAAGCT
TCCTTGGGACCTAGGATGAGCTCCCCTTTCTGCCAGGAACTAAAGAATTATGGAATTGTTCATT
GCTCACCTTGTCCCGTAGAGGAAAGAGTTAAGACAGGGGATAGTGTACAAAGGAGAAGGATAA
GCAAACAGAGCTCCCCATATGACTGCTGCCACATCAGAAAATCACCAAATCACTCTTTGAAAGA
GTTAACTGTACTATATTTGTTAATTTAAAGAAAGTATCTTTCTTTGATCTTTTATAAAAACT
ATTAGATCTTAAAATTCAGAGATAAAATATCACTTGACACATTTCCAGTGAAAGTTTGATATGT
TTTGTTATACTATTACTTTGAGTTGGCTCTAAGTTAGTGATTTATTTTCAAATAACAGAGGCTG
TACACGGTTACTAAGGACACGTTCCTATAGATGATTTACCTTAGTAGTGATTAGGCTGAAGACT
TTTTCATGAAATCTGTTTACAATTTCCCTTTCTGCTTTCAATGTTCAAATTTGAGTTGTAATCC
TTAGAACTATATTTCCTTCCCTAATCCTCAAAGATAGTTATGAATCTAATTTGAATCTAGAAGG
ATGCAAAAACAGAACAAAAATTTAAAATGATAAAACAAGTAATATGGGCAAGAACTTAAAAAA
ATATATTTAGTAAACCTTCATGATAGTGTGATGCAGTTAAGGGAAATAGGAAGCATAGTATCAC
TAGAATCTTACTTAGTGTGTCAGGCTCTTTTGCATAAATTATTCTCTGGAATAAATTAAATACT
TTGGTGCATGTATTTACTCCTTTGGGTCACTTTGATGCCATTAAATAATGCACTACTTTCAGCC
TGACATTTACTGAAGCATCAGAAATAAAATGCTGCTGCTCTTTAACCATAAATGGTACTTCAGT
GAACTCTAAAGCTAATACAACCAATATGTCAAACACAATGAGAAAGACATTTACACACTACACT
GAATTAAGTCTATGAAGATATAAAGGTTAAAAGAAGCCTAGCGTTTTACTTAAGTTTAAGTAT
TTTTGTATTTGAATATAATATATGTTTAAAATATAGCCTAAAGTTACAGCAAGCTAAAGATATA
GCTAGATTAAAACAATCTAAAGACAAAGAAATTAGTTCATTTCTGCTTCCACTTTATGTAATTT
AAGTGTTGATATTATTCTCACCTGTGCATTTCAGCATATTTAAAGTACACTGAAAACTATATCT
GCTTTGGCCTTTTAAAAATAATGAGAGTTCCTACTTCTCTGAAACTGGATCTCTGCTAATTAAC
CACCATTAATCTGAAATATCTTAATTCCTTAAGGAGAAACAAAAGTGTATATTACATATGCTTA
TGTAGGATACTTGAAAATTTGGTGTATCTTATTAAACTGCCAATTTAAAAACTGTATAATTTAA
TTATTTCATTTACAGTATGGACCATTTCAAAATGAAAAAAGAATGCTCTATGGTAGCAAGTCA
CTGCTATATTTGTTAGTGATCATTTGACAAATAAATAATTCATCATTCTATAATTGAGACAGTT
ACCTGTACATTTGCCCTGTTAATAAAATTACAGATTTTTCCCTTCCTGTGTCCATGTGACTAAC
CTGCACATTGTGCACATGTACCCTAAAACTTAAAGTATAATAATAATAAAATAAAATAAAATA
AAAAATAAAAAATAAAAATAAAATAAAATTGCAGATTTTTTAGAAATGCAGAGCATTAACAC
TGTTCTTGCTTTTATTTCCAGCTCCGAGTTTTCAAGTTGGCAAATCTTGGCCAACTCTAAATA
TGCTAATTAAGATCATTGGCAATTCTGTGGGGCTCTAGGAAACCTCACCTTGGTATTGGCCAT
CATCGTCTTCATTTTTGCTGTGGTCGGCATGCAGCTCTTTGGTAAGAGCTACAAGAATGTGTC
```

FIG. 6 (cont'd)

```
TGCAAGATTTCCAATGATTGTGAACTCCCACGCTGGCACATGCATGACTTTTTCCACTCCTTCC
TGATCGTGTTCCGCGTGCTGTGTGGAGAGTGGATAGAGACCATGTGGGACTGTATGGAGGTCGC
TGGCCAAACCATGTGCCTTACTGTCTTCATGATGGTCATGGTGATTGGAAATCTAGTGGTATGT
AGCAAAACATTTTCCTCATTTTCATTAAAAGATAATGTAATCATTAAAAGTGTGTTCAACTG
AAGAATATTTTGTATTTTTTAAATCAAGGCCACTTCCTATTGTCTATTACTCATGACTGTAAGA
GCCATGTATAGTTTAGACCATTGTAATCCACACAAACCCTTAAACTACCTTTTGAACCAAAGTT
ATTCTTTCTTTCATTATCCTTCTTGCTACAAGGAGAGAAACTTTTCTGTTATTTATCTTTCAGT
TCTTGTACTAGAGCATGGAAGTGTTACTTAGAACACTCATTTTATTTATAAGTACTAGCAATAA
CACCTGAAAACGTTTCAGATTTGGTTTTCTACAAATTTAAAAACTAGCAACAATCTCAGTTTAT
TAAGAGCTCATGGGGTTTTCGGTGCCTAGAAACTATGGTATGAGCAAGTAACATTGTCTCTAAA
AACATTAATTGTCATTTCTGCATAAAATTAACCACCCCTAACACCATATATATTTAGGATAGTT
AGCTCTTCTTGTTGCATTGATCCCTTTTACCATTATGTAGTGTCTTTCTTTGTCTTTTTTAAT
CTTTGTTGGTTTAAAGTCTGTTTATCAAAGACTAGGATTGCAAACCCTGCTTTTTTTTTTCT
TTCCATTTGCTTGGTAAATATTCCTCCATCCGTTTTTTTGTGCCTATGTGTGTCTTTGCATGT
GAGATGGGTCACAGCACACCGATGGGTCTTGACTCTATCCAATTTGCCAGTCTGTGTCTTTTAA
TTGGGGCATTTAGCCCATTTACATTTAAGGTTAATATTGTTATGTGTGAATTTGACCCTGTCAT
TATGATGCTAGCTGGCTATTTTGCTCATTAGCTGCTGCGGTTTTTTCATAATGTTGATGGTCTT
AACAATTTGGTATGTTTTTGCAGTGGCTGGTACTGGTTTTTCCTTGCCATATTTAGTGCTTCCT
TCAGGAGCTCTTGTAAGTCAGGCCTGGTGGTGGCAAAATCTCTTGGCATTTGCTTGTCTGTAAA
TGATTTTATTTCTCCTTTGCTTATGAAGCTTAGTTTGGCTGGATATGAAATTCTGGGTTGAAAA
TTCTTTTCTTTAATAATGTTTAATATTGGCTCCCACTCTCTTCTGGCTTGTAGGGTTTCTGCCG
AGAGATCTGCTGTTAGTCTGGTGGGCTTCCCTTTGTGGGTAACCCGACCTTTCTCTCTGGCTGC
CATTAACATTTTTTCCTTCATTTCTACCTTGGTGTATCTGACAATTATGTGTCTTGGGGTTGCT
TTTCTCAAGGAGCTTCTTTGTGGTGTTCTCTGTATTTCCTGAATTTGAATGTTGGCCTGTCTTG
CTAGGTTGGGGAAGTTCTCCTGGTTATCCTGAAGAGTGTTTTCCAACTTGGTTCCATTCTCCA
GTCACTTTCAGGTACACCAATCAAACTTAGGGTTGGTCTTTTCACATAGTCCCATGTTTCTTGG
AGACTTTGTTCGTTCCTTTTCATTCTTTTTTCTCTAATCTTATCTTCATGCTTTACAAATTTAA
CTCAACATGGATTAAAGACTTAAATGTAAGACCTAAAACCATAAAAACCTTAGAAGAAAACCTA
GGCAATACCATTCAGGACATTGGCATGGGCAAAGACTTCATGACTGAAACACCAAAAGCAATGG
TAACAAAAGCCAAAATTGACAAATGGGATCTAATTAAACTAAAGAGCTTCTGCACAGCAAAAGA
AACTATCATCAGAGTGAACAGGCAACCTACAGAATGGGAGAAAATTTTTGCAATCTATCCATCT
AATATCCAGAATCTACAAAAAACTTAAACAAATTTACAAGAAAAACACAACCCTATCAAAAAGT
GGGTGAAGGATATGAACAGACACTTCTCAAAAGAAGACATTTATGTGGCCAACAAACATATGAA
TAAAAGCTCATCATCACTGGTCATTAGAGAAATGCAAATCAAAACCACAATGAGATACCACTTC
ACGCCAGTTAGAATGGCGATCATTAAAAAGTCAGGAAACCACAGATGCTGGAGAGGATGTGGAG
AAATAGGAATGCTTTTACATTGTTGGTGGGAGTGTAAACTAGTTCAACCATTGTGGAAAACAGT
GTGGCAATTCCTCAAGGATCTAGAACCAGAAATACCATTTGACCCAGGAATCCCATAACTGGGT
ATATACCCAAAGGGTTATAAATCATTCTGCTATAAAGATGCATGCACACGTATGCTTATTGCAG
CACTATTCATAATAGCAAAGATTTGGAACCAACCCAAATGCCCATCAATGATAGACTGGATAAA
GAAAATGTGGCACATATACACCATGAAATACTATGCAGCCATAAAAAGAGTGAGTTCATGTCC
TTTGCAGGGACATGGATGAAGCTGGAAACCATTATTCTCGGCAAACTAACACAGGAACAGAAAA
CCAAACACTATATGTTCTCACTCATAAGTGGGAGTTGAACAATGAGAACACATGGACACAGGGA
GGGGAACATCACACACTGAGGCCTGTCGAGGGTGGGGGCTAGGGAGGGAGAGCATTAGGAG
AAATAACTAATGTAGATTACGGGTTAATGGATGCAGCAAACCACCATGGCAAGTGTATATGTAT
GTAACAAATCTGCATGTTCTACACATGTATCCCAAAACTTAGAGTATAATAATAATTTAAAAAA
```

FIG. 6 (cont'd)

```
ATTAACCATACCCAACACTAGTGTCCTGAATCTTGAAGGCATGGAGAAGTTGGGAAGGCATGGG
AAGATAAATATAACAAAGTGATATAACATGTACTCAAATAGAATTAAAAATAGGAAGTAACTAA
TATGTGTCCAAAAATATGAAAACAAAGTGCCATGTGTCAAGTTTACAAAATGTAAACCTTGCTT
TACAATAGGAAGGTTGATCAGGGAAGTCTTTGTCAAAGAGTTTGGACCTAAAATATATTTAACT
GAGATGTAAGATTTAGCTTGGTAGGAAGAAAGACCATCCCAAACAAGGAAACAAGGTACCCAGT
GACTGAGGGATACAGGACAGTAGACTCTGTGAGAAGTATCAGGCTCTTATGCTTTAAATATGAA
GTAATTACACCGAGTTGCTTAATTAGAACCCAAACCAATGGAATAGAAAAATGACTACCATAAC
AAGTAATTTAATGTATATACTCTTGCCAGGCTCAGTGGCTCACGCCTGTAATCGCAGCATTTTG
GGAGACTGAAGTGGGCGTTTCACTTGAGGACAGTAGTTCGCGACCAGCCTAGTCAACATGGCAA
AACCCCATCTCTACTAGAAATACAAAAATTAGCCAGGCGTGATGATGCACACCTGTAATCCCAG
CTACTTGGGAAGCTGAGGCACGAGAATTGCTTGAGCCTGGGAGGCAGAGGTGGCAGTGACCCGA
GATTGTGCCATTGCATTCCAGCCTGGGTGAAAGAGCGAGACTCTGTTGCAAAAAAAAAAAAAAA
AAAGCATATACTCTTTAGACATGATTTCCTCTCATATAAAGGTAACCTCCAAGTCCCCAAAGAT
AGAGAAAGGGGAAGGGAAAAAGGCAAAGTATTATTTTATTTTTATTCATTGCCAAATTTCAGCC
TCTTCAACATTACTTTTGATAATTCTGATCTATTTTAAAGTAACAAGAAACATAAACAGTGTA
CAATCTAGAATTATAAACAGTGGCTTAAAACAATAAACACTGATTACTTCATAGTTTCTGTGGG
TCAGGATTTGGGGAATAAGTTAGCTGGGTGGTTCTGGTTTAGGATCAGTCATGAAGTTGCTGTC
GAGATGTTAGCTGAGGTTACAGTTATCTTGACTGGGGCTGGAGGATCAGCTTCTAAGAAGGCTC
AATCTCATGATTATTGGAAGGAGGTTTCAGTTCCTTTTTGGCAGTTAGTTGAAGGTCTCAGTTT
TTCTCTGCAGGACCTTTTCCATAGGACTGTTGAGTGTCCTTATGATATGGCAGCTGGCTTCTTC
CAGGGAAGGTGATGTAAGAGAGAAGGCAAGGAGAAAATCCTCTTTATGTTCTACTCTTGAAAGT
CACTCTTCACCACTTCTGCCATATTGTATTCATTAGAAGCTAGTCACTAAGAAGAGCTCAAGCT
ACTATAATCCCCAAGACAACTTTAAAATGTTTGCTTTCAGAAAAGTATAAGATCACATAGAACA
GAAAGTGCCATAGGGTTACATAGAACAGAAACAAAGAAAAGATAATATAATTATGTTATAGATT
TGATTTCATTTTCTCTGTATGTATATTTGGTATATGTTGGAAGAAGAAAAGAAAACGCAGAGAA
CAGAATCCTTTATGACAACATGAATGATCAGACAGCAATGGGGAATTAAGAAATATAAGTTTGG
GACCAGATTGGGTAGAATTTAATTTATGAAAAGGCTGACTGTGCATAATAAAATGTATTTTCCT
TTAGGCAATTCAAAGCTACAGATGATTTTTTATCAGGAAAGTGACAGTGAACCAGTGATATTTT
TCAGAAATATACGTAGCAGGAGAATGCAGAATAGATTTAAAGAGGATGAAACTCAGCCCACCAC
ATGTTATCTATTAGTTTACTGAAATTAACATATCTCTAATGTATAAATGTGCAGAAAATTGA
AGTTGAAAAGAGAATTTCAGGAAATATCAAGTACTTATGGTTGACATCAGTATTAATTTAGATT
GTGATGTATGCATAAAAAGATATAGTTTATAAAATAATCATTTCCATCTACTGGGTGTAAATTT
AATTTTTGTTCTTTTAAGAGAGAAAAATTAAAGGTTCTCCTTTCTTTTTGACTATCAGTTAAAA
TAACTTCTTTGTCTTGTGATAACCTGGGTATGTTTCTGGAGTAGCTAAGGTAGTCATATATATC
ATGTTTACCACTATTAAGGAAATGTGCTTATATAACATTTGCTTAAGACTGAATGAACTTGATA
TACTCACTCCTTACTACAATTCTTCCTTCCTATTCTCACTGGAAAAATGGGAAGGTGTCCCAA
AGACAAAATGGCATAACTTCCTTTTAACACACATGAACTATCAGATGTGGCTCCACCCAAATAG
ATGTAGTAGTCACAATGGATGGGACTGCCAGCCTAGTCTACAGACAAGACAGAGCTGGGACCAC
AAACTACTGTTTCCCAGACCAGGATTTTTATGAGCCATTCTTAGTTTCCAGACACGATGGCAAG
AGACCCTTCATTGGTTGAAGATAGGTGCTGCAGAAAAGAATGTGACTTTCTGAAAACTGATAG
TTCTAGAAGCAGAGAAGACAACTTCCTCTCTCCCTAAGTGAAGGTGAGGCAATAGCACACAGGA
GGGATGTGAAGGTTTTGGCTTCCTCTCACAAGTTGGGAATCAGGATGGAGAAACAATTAAAATA
TGTAATATGTTTCAACCTTGAATTCAAAATGGAAATTATGGTAACATTTCCATTCCAAGAGGCT
AATTTGAGACACAAGAAAGAGTTGATTTCATTTACTGAGCTAGCACATTTGTGAAACAGGATTC
AGGATTTCAGTCCCTGAGTGAGCTTGCTGAACTGTTTTCTTTCTTTTTTTTTTTTTTTTTTT
```

FIG. 6 (cont'd)

```
TTTTTGAGACGGAGTCTCGCTCTGTCGCCCAGGCTGGAGTGCAGTGGCGGGATCTCGGCTCACT
GCAAGCTCCGCCTCCCGGGTTCACGCCATTCTCCTGCCTCAGCCTCCCAAGTAGCTGAGACTAC
AGGCGCCCGCCACTACACCCGGCCAATTTTTTGTATTTTTAGTAGAGACGGGGTTTCACCGTTT
TAGCCGGGATGGTCTCGATCTCCTGACCTCGTGATCCGCCCGAGGCCTCCCAAAGTGCTGGGAT
TACAGGCGTGAGCCACCGCGCCCGGCCTGAACTGTTTTCTTAAATTGTCATGGATCACACCAAA
CACCTGTGCCAGCTGTTATGCGCATACCCTTCGGTAACAAAGGAAGTCCAGAAAAGAGAATAA
CTTGACTCACACAAATATTTCTAGGGAAATAAGGTAAATAAAAGATAGTGTTGTGGAGGATAA
GTTGGATAATAGTAAGTGATAACAGCTAAACTTTCTCAAAGGTTCACTATGTGCCAAGAACTGT
GCTGAAAGCCACATGAATTCTGTCACTGAATCCTTTCAACAACCTTGTAAGCTGGGCACTAGAA
AAACGATTACATTTATTTTATAGATGAGGAAACTGAGGCTCAGATTGGTTATGCTACTTAGTAG
GTAACAGAAATCGATTCTTACCTAGCACTCGAATTCTAAAATATGTGCTCCTCTATGTCAAGT
AATCTATAGAACTAAGATAAACATGCTGATGAAAGTTAGTGTCTAGTGGGTATTAATAAACGCG
GTTTCAAAACTGTGTCACCACGGGTAGATTGGCTGCTTTAAAAAAATAAAAACTTCAATGGAT
TTATGAGAAAGAAAGTCATATGTTCCAGGGATATTTATTTATTTTCCTGACAGTGGAATAGCA
TTGAATTGAGTTATCAATTCATAAAGATCAGAGAAACAATTCGAAAATTAATAGTAAACCCTA
TTATACTGACTAAATATGGTAGCAGTTCAAAGAAAGGAAGTATCGGTAAGAGTAAACATGGAAT
ACTGTTTCCTCACTTATTCTGCAAACATCACAATTAGGAGAAAAGACCTTGTAGTTAGACTTTC
AAAAAAAAAAAGCTTCTCTACTTATTAACTGTGGTCTTGGACAAGTCATGTAAGTTGTGCAGA
AGCATTTTCATCTGTAAAATAGTAATAATTCCTGCCTTATAGAGTTGTGAGAAATAAATCACAT
AAACCTTGAAAATGCTTTGCACAATAACTGGTATTTACTAAGAGCTCAACTAAAAGCTGGTTT
TACTTTTATTGTTATTATGATCTGGTATTGATACTGCTCTAGGACTTGGCTCTAAGGCATGTTT
CTGACCAAAAGATCTCCCAATCTATCAGTAAAGCTGTGCTTGTTTTTTTTTTTTTTAAAGAA
TCCAATATAATGTGATAGGGATGTGGATGAGAAATTTAACAGGACAGAATGAGAAATGGGAGCA
GGCTATATAAATGTCACAGTAAATGACATTTGTAAATAGAGTATTTGTCCAGTACAGAGGCAAT
ATAATTGGCTCCCGCCCTGGGGAAGGATTGATGGATGTGTATCAAGAAAAATTTCCAAATAGAC
AAATGACAGAACTTTAATATACTTTAGGAAAATAAGTCTAGGAAATAGCACCAAAATAGATAAA
ATAAAAATTTTACATGCAATTTTTTCTTCCTTTGTCTGTTTTTTAATCCAAATAATAAGTTCA
AAAGCAAATTACAATAAAACATAATTTTATTGGTAAATTCCAGAGGCAAAGGAGCAGGTCTGGT
CTTAATGTGATTATCAGGAGTCATAGTATAGAGACTGACAGATTGTCAGTACACTCTCAAAATC
AAACGTGGTCTTCATTGGATCTTACATATTTTACTTTAAAAAAATCACCATTGGTTAGACTA
ACTTACAACTAATTAGACAAAGGTGCTGTAAGCCTCATTAGCATGATAGAAGCATGAGAATATA
GCAAGAATGTAGAATCCTTTTTATTGAAGTTTTACTTAAAAATTTTCCTAAGATTCTACTTTTG
TACTACAGTTTGAGCATCCCTAATCTGAAAATTTGAAATCCAAAATGCTCGGAAGTTCAAAGCT
TTTGAGCACCAACCTGATACTACAAGAGGAAAATTCACATCTGGCCTCCTGTAATGAATCGCAG
TTAAACCACAGTCAAAATGTTGTTTCCTGAACTAAATTATTAAAAATATTGTATAATATTACCT
TCAGGCTATGTGTATGTGTATGAAACTTAAATGAATTTTATGTTTACACATGTGTCTCATTCTC
AAGACTTGTCATTATGTACATGCAAATATTTAAAATCTAAAATCCAAAACACTTCTGGCCCCA
AGCATTTCAAATAAGGGATATGCAACTTGTATTTACTTTGTGCATTTGCCCCCCTTTACTGCTA
TATCTTTCTTTTGTTCTGTATGTTATGTGTGCTTAAATAATCAGGAATTCATTGATATTGTCAA
TCAAATCCTGAAAAAAATTATATGACTCAGTCTTGTACCCCTGAGAATGTCTGATTTCTTCGT
AAGTTGTCTTTTTTTTTTTTCCACAATAGTGAGTTTAATGTCATGAATCTTTTCACTCATTCA
TACTGGTGGAGCCTATTTTAAAGACCCAATTTGCAGACTGATTACTGTCCTTATTCATGGCAA
TACTTCAACTCCACAATCTTTAATTCAACAATAACATCATAATTATTGTATAATAACCATTTTA
TAGTATTTCTCACTATTGTATAATTATAGTAGCCATAATTGTCTTAATAAAAATTGGGACTTTT
CATCCAGCAATAAATACGTTTTTGTCTGATTTGTCCAGTTATCTAGGTACAAAAAATGGTACAA
```

FIG. 6 (cont'd)

```
AGGCACAAAAATAAAATCATATTTAAATATATTGGGATAATTGTTGATTTTAGGAATAAATTAT
CAGTGTTTCCGGAAATCCAAATTACATAGTCAAAATAGCATCTGTATTAGGCCATTCTTGCATT
GTTACAGATAAATACCTGAGACTGGGTAATTTATAAAGAAAAGAGATTTAATTAGCTCATGGTT
CTGCAGTGAGCTTGGTGCTGGCATCTGCTTGGCTTCTGGTGAAGTCTCAAAGAGCTTTCAATCA
TGGCAGAAGGCAAAGTGGAGCAAGCATTTCACATGATGAAAGCAGGAACAAGCAAGAGAGAATG
TGGGCAGGAGGCACTACAAACTTTTAAATAACAACATCTCATGAGAACTCACTAACATGAGGAC
AGCACCAAGGCATGAGGGATCTGACCCCATCATCCAAACACCTACCACCAGGCCCCACGTCTAG
TGCTGGGGATTACAATTCCACATGAGACTTGGGAGGGGCAAATGTCCAAAATATATCAGCATC
CCAAATAAAAGGGTTTTTTTTGTACAGTTGTCTATATTTATCTTTTGGAACTGAGCTTAATAGA
AATGTTTCATTTAGCAATGATTTCAGTATTTTCTGCAATGACTAAAAAGCAAATAGTGATAATA
GTATTATTTATATTGACCAAGCATTTTTATTTCATTCACTTTTTTTCAGAATAGTGTATCATG
AATTAGCAGAAATGCATGTTAGAATAAAATAAGGTGTCAAGAACAATCTTAGAAAACTAATGAT
GGAAAGCAATTGAAGCAATAGAATGTTTGATCACCTGTTTTTCCTGCTGTGTTTCAGGTTCTG
AACCTCTTCTTGGCCTTGCTTTTGAGTTCCTTCAGTTCTGACAATCTTGCTGCCACTGATGATG
ATAACGAAATGAATAATCTCCAGATTGCTGTGGGAAGGATGCAGAAAGGAATCGATTTGTTAA
AAGAAAAATACGTGAATTTATTCAGAAAGCCTTTGTTAGGAAGCAGAAAGCTTTAGATGAAATT
AAACCGCTTGAAGATCTAAATAATAAAAAGACAGCTGTATTTCCAACCATACCACCATAGAAA
TAGGCAAAGACCTCAATTATCTCAAAGACGGAAATGGAACTACTAGTGGCATAGGCAGCAGTGT
AGAAAAATATGTCGTGGATGAAAGTGATTACATGTCATTTATAAACAACCCTAGCCTCACTGTG
ACAGTACCAATTGCTGTTGGAGAATCTGACTTTGAAAATTTAAATACTGAAGAATTCAGCAGCG
AGTCAGATATGGAGGAAAGCAAAGAGGTAAAAATGTTTAAATAAGGAGATATTTGGTGTTATA
TAATTCTGTTGTTTAAAATTATCAGGTGTTTTTAAATTGCGTGTTTCCTTCCTGTTAAGAAAAT
AGAAAATATCTGTCTAGCAATATATTTTCCATGGAAAAGTTGGTAATAAATAAATTAATGATAG
ATTAAAATATAGCTAGATTAACAATATGCTGACTTATGTTTCCAATACTGACATTTTGAATTCT
TGACAGTATTCTTGATATGAATTTTTTCAGTATTTATAAATAATTTTAAATTTCTCAAAATGCC
TCAATTTCTCCACTTTCTTCCTTGTAATTTGCCCACAACAGTGTTTTTTGTACGTACTGGAAAA
ATATCTGATGAGAGGGTAGTTGCAATTCTCATCTTGCTATGTTCTTAGTTCTTAATTCTTACGA
AATACGTCATAAAATAGTATTGTATTTTGTTTGCACAGACATATTTACTCAAGGAAGATCTGAT
TGGGATCTTGGCTTGATATTTATGTATAGTTTATCTTTCCTGAAGTCAGTCAGTTTTTTTGAAG
AGAAGGTATTGATGAGGAATCACACTAAAAACATATTTAACCCTACTGAGCTCAGTGTTCACTG
TTTAAAGAAACAAAAATCCTTAATACATTATAGAATGTAAAATTCTGAATTTACCAACTCAGTA
AGTCCTGGTAACTTAATGTATTCTTTGATTTACAAGAAGGGTATGAGCAACAGAATATATTTTT
TGTTTTGTTTGCTATTAACCTGTTGCTCAATAAGTACAGAGTTGGAGGTAAAGAGAGGAATTTA
AAACCTTGATATTTAATTGTTTATACAAAAATGAAGACAAGATTTCCAGTAATTAAAGTTTGCA
CTAACTAACAAAAATAACAAGGAAAAACAAAGATTCGTTCCTTCCTCATACGAACTGTTTGGCG
AGGAAGATAAAAGCTTCTATTCCTGATGTCGGGAAAGAAAGAATGACGACATGGGGAGTGTGG
GCACTGAAAGGTAAAATTTAAGTAGCACAACATGATCATGATAATTAACAATCAGCCAAAATTA
TGAGGGAAAATATAGTTATAAAAAAGAACAAAGATGGGTGGATCACGAGGTCAGGAGTTCGAG
ACCAGCGTGGCCAACATGGTGAAACCCTGTCTCTACTAGAGATTCAAAAAAATTAGCCAGGCGT
GGTGGTGCGTGCCTGTAATCCCAGCTACTCGGGAGGCTGAGGCAAGAGAATCGCTTGAACCCAG
GAGGCAGAGATTGCAGTGAGCCGAGATCACCCCATTGCACTCCAGCCTGGGCAACAGGATGAAA
CTCTGTCTCAAAAAAAAAAAAAAGAACTAGCTATTTCAGACACTTTTTCTGTATTTATTTGAT
AAAATTACTAAAGAGTATGTTATTTTCCATTTTTTCTTGTTTGTAAGTTACGTAGTATTGCTGT
TAGTGATTAGGTAGAAGTAGATGTTTAATGGGAAATTCAGACAATCTTTGAATATAGGAAGGTA
TAAATAACAGGGACATAGGTATCAGTTTCACAAGAAATAACTGATGAGATTCAAGGGAAAAGTA
```

FIG. 6 (cont'd)

```
ATAAAACCTTCTGTCCTGGGGCAAAGAATTACTTTAATTGGTTGAACTTAAATTTTTACTAACT
AGATTATTGTTTGAAAGTTGAATAATATCTTAAAATCTTATTAACAAAATTTTGAACAAGTGTT
GTTACAATAGTTGGGTTATGCTGGAAGGGTGGAGTGGCCCAATTTCATATACAGTGTACTGCTC
TTATAGAAGCTGAAGTCGGCATTTATAAAATAGAATTCGGTCATTTGAATTTTGATGTATATTC
CCCTCTCATTATTTTGAAATTATGCCTAATGGTGAATATTTCCCTAATAGTAAAAAAGTCAAT
TTTTATTTTCACACATGTTTAGTTTTAGGCTGTCATATAAACTAAGAATGAATTATACAGTATC
AAACGTTGAAGCCATTGGCTAGTTTAATCTTTTAGCTAAGTTTCAGTATCTTTTGAGGAATGTT
TAACTTGACATCCAGTCTTCTTAACTTTAAGAGATTTTACAGCCGTGGGTTTTCCAAAAGAGCG
TGTATTTTGCCTTAACTTAAGCCATTATGTCTGAAGTAAGAGGGAAGTCCAGTGATGTGGGGTT
TAGAGTAGGGACATCTCTTGTTTCTCTTGTTATCATTAAGCTTTTTGATTTGTTTTCCCATTAA
GTTAGCTCTGAGTTAAATACTCTAAAATAATATTTGTGAATTCAGTATTTCAGAATTGGAGGAA
GAGAACTGACCTGCCAGGTGGAAGCAGACAGGATTATTTTATTGCTTGAGTTGTGGAGTCCTTC
CAATACCTTCCCAGCATAGAGACTGTTACTTCAGTGTTAACATTATTTGGAGGGGTTTTTAATT
CTGGCTTTATATCAAACTTTCTAGACATAAATTTATAAAATAATAAATGATGAGGGTTATCGCC
GTGAAGAGGTTATGTGTAGGTTTTGATCTTTCAGAATTTTACCTGGTAGCTCTACACTAAAAA
ACTAGAGAATTAAAACAATTATTGAAGAATTTCAGACACTCGCATTTGAAATAGCATTTCTTGC
CTGCCTTCTAGTCATTTTTGTCTGGTCATTTTTCTAACTGGGGACAGGATTACATTGTTAAAT
ATCACAAAGTAGTAAGAAACATCATGAGGCTTATTACCAATCCTTTCTAAATTAATTTTTAAT
TAAAGAAAAAATGAGGCTTTTTTACTGGAATGTCTAAATGAATTTTTTTATAAGGCAGACTGAG
TGGACTCAGAGGTTTTTTAGGTGTTCACAGTAAGTCCTCTGCAATGTCTTTGCTAAATTTGTAT
GATTCTTCAGTAGTTTTCTGTAGATTCTCTAGAGTAGGCCATTTAAAATCATGTCATAATCCCC
TATGCTTTAATTTTAATGTTATTTCGATTATATTAATGTAATTCCTTTTGTGATTTTGAATGAT
TGTTTTTTCTTTTAGAGTATTTAATAATGTGGAAGCCATGCTTGAATGACTATTTTTCGAAGTG
AAATTTAGTAGTGCGATATGGTGACCTTCACCGCTTACCATTCTTACTTCTCACAGGAGTAAAA
TCAAGCTGGAGCCATCAAGAATGCAGCTCTGGTGTTTTTTAACCAGCCAGAGGCTCGTGCCACC
ACTTTTACCCAGGTTACCCAAGCAAGTTGTACATCTATAAATATAATCAGTTTCTAAATGACTT
TTGACTGGCCTGCATGTTACTCAGCTACGTTCCTTGCCCTTCCATTGGCAGTAAAATAAAAACA
TGCACAGCTGCTATTATGCTGAGTCATACAAAGCATGGTCAGGCAAGTCTGACAACCCTAACTT
AAAAAAAAGTGATTTAGCTGCTAATTTTCTTACATAGATTTAATAGAAATTTTATTCAATGAA
AAGTAAAAGTGCATGCCTTTATGGATTATTTAATTTCCTTTTAATGTTACAGAGTTTTGAACAT
ATTAGGAGCCCAAAGGAGAAATGTAGGTGCTCTTTGAAAACTTGCAAAAATGCTTTTTATCCTC
TGTCTTTAAAAAAAAGATAGCCCAGTTACTGTACTTAAGTCTTGACAGTTTTTTATTTAGTGTA
ATGTTTTTCTGAAGGGTAATCTTCAAATTAAAGCAATCCCTTATTCATATGCAAACTTCCCAAA
GGATGTTTAATGTGATAATAATGTAAATGAATAGGAATGTCTGTGTTTCAGTTGCTAGCAGCA
TGGGTATAATATTTATCTGCTTCATTTTAGGGAAAATGGCACTGCTTTATTTAGGAGTTGACCA
ACAGTATTTTGTATTTAGAATATAATTTCTTTGGAAAGTCTGTTTATATTTACCCTTAAAACTC
TTAGACTGAAAGAAAAGGAAATCATGTCTTTTGTATACCAAATAATAATAATAATAGTGATAAT
GAGAGACTTATAGATGGTATGCTCCTTCTAAAAATAGATTTAGAGTCCATCTTCTTCATTTTCT
TGGCTCCTCTGTGCTTTCTCTCCCCTCTATTTTATTGAGACCTGCTGGAAAACTTTCTCCCGAA
GAATATTATTTAAATTTATCATGATCCACAAACTCCTGTATAGGAAAAGAATCAGAAACTCTTG
CTCCTAGGGTGTTTTTAAAATGAAGAGACTTCCCTATCATGTGACAATAGCAATAAACGTAACA
TCATTCTATGGGATCCATTAGTCGACCTTCATTTCTTAATGTTGAAATCACAGTTTTATGCACA
AATATTTAACCAAAATGCCTAAACCCAATTTAATCATTTTAAGAAATGTTAATTATTTTGTCA
CTTAGATACAGTTTCCTCTCCTTTTGCCAATAAAACTATAAAACAGCACTAATATAAAAGTGTA
GTTGGCTATTTGGAAGAAGCAATAATCATGCCATTCCTGGAGCATTCTTTTATACTTTGGAACA
```

FIG. 6 (cont'd)

```
AAATATTCCATCACTGGCTCTCCAGATTCATGAGCTATAATGCCTCATATATTGGAGGAATGGG
ATGTAAAATGGGATCCAAGATGCGTAATTGTTTACAGTTAAACACAGATGCGCATATACACAGG
GACTACAGATAATTACTTTTTCCTATTATGTATTAATTCTTCAGAAAGCATGAGATTTAGGCA
CTTTCGGATAATAGCTTGTTTCTCGGAAAGAGGCAAGGGTAGTTTCCTTATTCTCTGAGTATCC
CATTTTGCCAATTTCCTGTTTAGAAAGATACTTGAGGCATATTATCCATCAACGTATCTAGGGG
ATTCAGCTGGAGTAAAGGTGGTAGAATAGAAGCTAAGAAGGAACTGGTTCGTTTATTTTCAATC
CTCACATTATGGCAATTTTTGATTTCCTTGTAAAGTCTATGATTCTCCCTCAGGAAACATTGT
CCACTTCCTAAAAAATATACTAATTTCTAATACAGGGGTTTGGAAAGGGGACAAAAATGTGCA
GGGAAGGTTTGCGTAAGCAATGGTGGAATGGGTTCAACAGACACCTGTCTATGACTTTATCCTG
GAGAATGTGTAGTCCTCATGGGAAAGTTTTCCAGTGGGATAGTGATTAAGATGGAAAAAAATGC
CCAAAATATCTTTAATATAAGAACAAAATGGGCCAAACACGTGTCTTTGGGTCACTGGTAATCT
ACTGAGCAGTAGGACATCATGACATAAGAGTTCCTTTTGCCATCCGAAGAAAAATATTTAAAAT
CCTATTATTTGTGGTTTTAAAAATGTTATAATGTATTCATTATAAACACTAAATGACTTTCTG
GATAATATAGTATACTGTGAGTAATTATTTTGATTTTACCATATTCTTTTTAGTTCTCAGAAA
CCAAAATTGTCAGATATGGGATACTTGATTTAATCTGTATTTGAAGTTTTCTCTTTTTTAAGTG
CCAATTTTTTAATTAAATTAAATTAAAATCTCTCTCTTTTCCCAAATTATATACAATATCTA
CTAATTATGTTTTCTTCGAAATGTATCTTAGCTTCATAATGAGAAGTGAGTGTGCCCATGAAAA
ATTTAATAGGAAGTTATGTTTTCTCTTCCATTTTCTGTTGTGATTCATTATTTTTGAAAATAAT
TTACTTTCATTTGCTCACATTTGCTGTCTAAAGAAAAACTATTCATCTGGCACATTCATATTTA
GTAGTATTATTAAAGCAGAAAGCATAAGTTGGAAGTATAATATCTAAAAATACAAAATGAAGTA
TTGTACCTTGATGTTTATTAGATCATTAAGCAAAATATGATTCTGCCCTGCTTAAATCATTTGA
TTATAATTATCCAGCATATAAAAGAATCACAGTAGATTTTCAATAGGAAGAGTCCTATAATATT
AGGTATCCACCAAAACATTGTTCAAGTAATATTTCCACCTGAAAGTAAATGATTGCCAATGCT
TTTTTTCAGAGCATATAAAATTGGCTATTCCTATTTGATCTCGTTATTGTCCTGGCATCCTTAT
TTTGTTAAATTTTAACTAGGCAAGGGCTATGCTACAAACATCAGTTAGTCCGCTAGTTTCCTGA
TAAATAAGTACAGGTAATTAAAAAGTGAACCTAAATATCCAAATTATACCAAAGGGACATATAT
AGAACTTTTTAAACTGGATCTGCTTCTAGCCAGTTCATATTTTGGTCACTTACTAATGTAGTAT
TTCACCATAAATTATGCCTAGATTGGAGCATTTACAGGCACTCTTTATCTGAAAATTCTTAAGT
GCATGAGTTGTAACAGTTTCACATAGTGATCATCTCACTGTTCTAATTGGTGACTATGTACTAC
AGTTAGGTTGATCGTAATTATGACCTTAAATGAAGCTGAATATTTTATATTCCTAATTTGATT
AATTTTATTTTATGGGCTTTTACACATTTTAACTGCTTTAGTCAACATATTTTATAATATTATG
ACATTTGCCTAGAATGTAATTTTAAGAAAGTCATTTAATTGATGTTATCAAGAAGGGTTTTATA
AATCAGAATTTCCTGCCTATGTTTCAAGATCATTGCTTAAAGAAACTTTTTGTTCATGTAATA
TTCCAATGTGTATTTAGCTTTACTCTACATTAAAATATGTTAACAACTATGAATATAACTTGAA
TTAATACTAAAGTTCATGGTTTTGAAACATGGAAATCAACAATATCATAAGCACTATCTTGAAC
CTACAATATTTGATTACATATCTAGTCTACTAAATGTTTTAAATTGATAAACATTGGGTTTACT
TTTGAATCATCAAAAGATTCTTTAGAGAAGCTTGGCAGAATGGGGTGCAGAAGATCTGGAATC
CAACCACTGATTCGCTATAACTTTTCACAAGACGATAAAACTCACATTTCCTTCTCTAAATAAA
TACTGGATTGGCTGACATTAAGGATCAATGTGCTGCCTAGATTCTTTGTTATTTGTAAATCAAG
TACCACAAGTGGAAAAGTATTCAAGTAACACATGTGACAGATCCTGTGCTGCTCCGCTTCAGAA
GACAGTGGGAAGGATAAGATTGCATTCCTTAAAGAGGCCCCATTCATCACTGGAGCTATAGAT
CCTTGTATACAGAGTGAAAAGAGGGAAACACTGTCAAAATGATTTAGTAATAGTTTTCCTGAC
TCCACAGTTAAACTACAGTTCACCTCATACACTCACATTAGGTCCGAATAATTGGCAGACTGGT
TTTAAGACAATACTCCTAGTTCTAAGAGTTGTTCGTCATTGCCCACACAATTCAGAATCTTAAA
AGATTTGTGTTACTCTGCAATTAAGAGAAAATATTGTGTGTATTCTTTTGAATGTGAAAGTAAA
```

FIG. 6 (cont'd)

```
TATCAGATAGGAAGTGTTAGTAGTTAGTGGTTGGATAAAAGAGTCCTCGCACTGGTCATTCATT
CATTTACCCAAAATTTATTAAACACAAACATTGGTGCTAGAGATACAAGGGTGACGAAAACATG
ATCTTTCCTCCAAAAAATTAAGTCTGATGAGATGCATTTTCTAGAAACACAAAATACTTTTGAA
CTGAACCTTGGAAAAGTAAAAACTTGACCTTTCAATAGATAAATATTTGGCTTTAGGAAAAAG
GTATCTTAATTCTACATCAGAACTAAGGTAGTGCACTAAAATGAAAGGGAGCAATGTTAATTCT
TCTACTTTTAATGTGATTTAAATAAGAGAAATACAGGAATGTCTTTTATAATTTGAAATTCCA
GAGAAAATGAATAAAAAGCAATTAAAAAAACACCTCAACATGCTTCTCATTTTCAGCCAAGT
ACAGCAAACTCTGTTTGATATTCTCTGATTTTAACCTTGGATCAAACTATTTGGCAAATTGCTA
ATTTGAACAGGCTATTGAAAACAGACAGTGTATCTAGCAATTCATTCATTCATTCAATACTTAA
TGAACAGCATTTTGGCAATTCAAAGCCTGTTCCTTGTATTGAACTATATTGGTGTATTATCCAT
ATGGCCTAGAGTACATGTGTATTATTCATATTATCCATATTGGTGTATTATCCATAGGGCCTAG
AGTACGTGGCTTCTGCCCCCAAATGTCTTACAAGCATGTTAAAGTACCCAAAATCCATCCAACT
GAAATAATTTGACCCATACATTATCAAGGTTCAAGATGTGTGATAAGCCATGAAAAGGTTGGTG
AATAGCCTAGGGTGCATATGGTGAGTGAAGATGGATGGAAGAAATTAGGAGTCCAGATTTATTG
GGGAGACTTTATGAAAGCAAGGAATCATGATTGTTGCAAAATAGACAGTGAAGAAAGAAATGGT
GTGGTGGTGAAAGTCTTCCCAAAGTCATTTAAAGTATTGGCAACCCAGATACTTGGCAGCAGGA
GTGATAATTGATGTTACAGGAATCCTATGTAAACTTTTGCACATTTTAATGAAGATTTTCTATA
ATATGCTGTCTGGTGACTTCTCCCAATCACTGTCAAGGGCTAGACTTCATTATTTTAAGATGTC
TTTCATTCATTTATTCACTCACTCATTCTTTTTTTAAGCAAAATTTATTAAGACCTGTAACAT
ACTTAGCACTGATGTAAGCTCTGATACAGTCATTCAGTAATGTCAGCCTGAGCATTTGCAGAAC
CCTGAATATGGATCCTCATTTTTCCCTTGGGGTCACCCGAAGTCTTACCCCGTTCTGTGTTTAC
AGTGTGAACCTTATTCTTATAAGGAATATTTTTGTTTCTTATTGTGGATTGTCTGTACTTCCA
TCAGATGTGACTCAGCTTCAGTTTTTCTGATTACCTGTGTTATTTCCAACATGTTGCAAGTGA
TAAGATCAGTATTATCAGGTCCCTAATAGCATAACAGGTTCGTGTGAATTAGATATATTAAAT
GAGAAGATTTTTAAGTCATTTTTTAGTCAATTACGTGTATAGAAACATAGTTATACTTATCTCA
GAAAGATTCCAATTCAAAGGATAGGAAATTAGAAAAACATGTAATGTTTCTTCTGAGAACAAAT
ATATTCAAATTTTAATGACAAAGATATTAGGATTATTTTCTAGTAATTTGATATACCTGATAA
ATTAAAATAAGAAATCATCAACCTTCAAGCACCTTATAATATATAATCTTTGATTTAACTTTTT
TGGACAAATTAAAAAATAATTCTCTAACTCAAAGCAGGCAGAAGTATCTAATATTTATGCTTCC
ATCATTAGTATTTTTAAAGTACAAGAGACAAAAGCATTTTTAATCTCATGTATATCATACATCA
ATATTTTTAAGTCATCAGCATCACTATGCTAAGGAAATATTTTATATAAAGAAAATTATTTTC
ATAAAATAAAGAAACCATCTTTCTAGAGAAAATCCACATAATCCTATGCCCAAATATAAATATA
ACATTTACAGTACTGACTACAGCATCCATCTTATTCTAGTTTAACATACTTCAGTGTGCATTTT
ATCATGTGCTTACCTCATCCTTTTTATAAAGTATCTCTTATCAGCTCAACCATTTCCTAATGTT
ATGCACTAATGGTAATAACATTGTAACAGGTCCGAGAATGCTGTGGCCCAAACTACTCTGATTC
CTGTGTGGCACTCACACCTGGCCCTGCATCATTTCTAGAGCATTTTAAGACCAGGTTAAAGACT
GGGATCCCTTCATGTATGCTGATCCCAAGAATGGACCGACCTGGCTAAAGTTTATTGCATTTCA
AGATATAAAACAACTTCTATTATATTTTCTTTTGGTGATATTTGATTTAACCTAAAGGAAAAC
AAAAGAACAACTAAATATTCATTTCTGCCTGTACTAACAGGGCAGGTAAGAGTGCCAGAGTAAC
AAGTAGTTTCCAAATGCACAATGAAACACAGGAGTGCATTGGCCAAAGAGAATGCAAAATATCA
GCTCTTGCTATATAGCTAACAATGTGCTGCTCTTTTTGGAATTAGAAAATTATAGAATATATTT
AATAACAATCTGGTATATGTTTTCATGTCAATGAAAAGTGGATAAATTTAGATGGTTGCTGTTT
ATGTGCATTTGATCAAATCTTTTCTGAATTTGACATGAAAATACACTTGTGCAGCTTTCATTGG
TTGGGTCACAATTTTAGAATAAAACAAACTATTTGAAAACCATTTGCAAACTAATGTACAAAAG
CAAGATCGCAGATGATTATATGACTCTGGCAGCTTACATAAGCTTTCTGCAGGATTTTCTTTCA
```

FIG. 6 (cont'd)

```
GAATCTCTATACATAGGCTCAAACAGAAGTTATTTCCGTTGTTAGCACCATATTTTAAAGAAAA
AAAATACTATGGTGTTGTATCTAATCTTGTGACCCCTGACCTTTACCAAAGCGGATTGGCATTA
TGTTTAAGTTCTTAAATTACAGATCAAGAAAATGCATACAGAAGATGGGGGGGGGCACACCTA
ATTAATTTTATATTTAGATTAAAGAAAATAATTAAATGTGTTTTTTGTGGGATTGATTTTCA
GAAGCTAAATGCAACTAGTTCATCTGAAGGCAGCACGGTTGATATTGGAGCTCCCGCCGAGGGA
GAACAGCCTGAGGTTGAACCTGAGGAATCCCTTGAACCTGAAGCCTGTTTTACAGAAGGTAAGC
AAAACAATAACATATGTGGTCTTGAGTATCCTCTTTTCTACCCATTTTTTCCTATTTATTTAAA
TGTCTGTTTATTTGTCTACCATCTATTATCTATCTATCTGTATCTATCTATCTATCTATCTATC
TAGTAATCATCTATACCTATCCAACAACTGTACATTTATTTGTTTTTTTTGCATTTGCTGTTT
GAAAAAAATGCAACTTTTTAAAAGGCAAAGTTTAATTTATGTAATTAGATATTTTCATTTTA
TGAATCATTTTTAACTCTAAGAAATTATTAACTGGCTTTTCTGTGGCCTTCTAAAATATCTTAC
AGGAGAGAAAGCCAAATCACACACATCTCTCTTTAGTTTAAAAATTCAATAAATAAGAAAGTGA
GAGAAGTAATTTATTATGTACTATTTTGTGATATTATAATGGGTAATAATTGATAAGTGTACAT
TTAAATTTGTCCTTGACTGAAACAGCTCCTATTTCAGTCAAGGTCAAATATTTTTATTATTTC
TGAAAAAGATAGATCATAAAAATGCCAAAATATACTATGAGTCATATGATATGGGCAATATG
TCACTGGAGTAATCGCAAAAGGATTTTCTGAAGAAAGCTAAAATTATGTAATTTGAGGTATGGA
TCAGTTATATATTGTAATAGCAATGCTGTGTATCAAACCACCAAAAACCCTGGGCTCTAAGCTG
CTTTTCTAGTTTTGACTCCTATTTCCTTCTGTGTAACTCACAGACTTTCTTGTCACTAAGTTTT
ACTTGTATCATTGTTTCTCTATTCTTACAGCTTCATTTTCTACATATGTCTCTTATATATCCTT
CAAGATCTAGTCTCAAATCCATTTCCTCCATAAAGCTCAGAAATTAAAGTTTACCAGAAAACTC
TCATAATACTTTGTTTTGTGATAATTGTTGCTTTCCATAACTATAGAATTGTAGACAAATTGCC
CCAACTTAAAATGTACATTCTTTGAGGACAAGGCTATGTTTTACATGTTATAGTATTACAATTT
GTTCTATGCAATTTTTTGACAATAGTAGATACTCAATAAGTATTTGTTGAAGAGCCTTTGATCT
AGCAATCCAGAAATTATACAAAGGTGTTTATTGGATTGTTATTGATAATGGCCAGATTTAAAGC
AAACGAAGTATTCAATAATGGTGGAATTGGGCTGGGCACAGTGGCTCACACCTGTAATCCCAGC
ACTTTGGGAGGCCGAGGCAGGCGGATCACTTGAGGTCAGGAGTTCAAGACCAGCCAGGCAAACA
TGGTAAGACCCCATCTCTACCGGGCGTAGTGGTATGTGCCTGTAATACCAGCTACTTGGGAGGC
TGAGGCAGGAGAATCGCTTGAACCTGGGAGACAGAGGCTGCAGTGCATGAGCCGAGGTCAGGCC
ACTGCACTCCAGCCCGGACAATAGAGTGAGACTCCCTCTCAAAAAAAAAAAAAAAAGGTGGAAT
AGTTATATTAATTATAGTAATCATATTTAGAGAAATATTATGAAATCTTTCACAAATTTATTTA
CTTATAATAAAGATGGGAAATAGTTATACCATTAAGTGAACTAATCAGAATTCAAATATGTAAA
GTGTCCATATAGAGTGGAATTACACTCATAGGATAAGGACAGGATGGAAATACCAACTTTTGGT
AAGTTTATTTTCTTTTTGGTTCTTCTATTTTTTATATATTGTGTTTTTGTAATGTAATCCATTA
TAGTAGTGCTATAAACATAAAAATAAATATTTATTAAACAAATGATTAAAAAGCCATATAGATG
ATTTTAAGATAGCTTTTGTAAGCGGAAGCTATCTTAAAAATTAATGTTATTTACAATGTATTAT
CAGGTAATAATGTAAATGAATCTCCCACCAACACAAATATACCTAATCAAAGAGTAATTTTTG
TCTTCATTTTTTTCCCACATATTTTAGACTGTGTACGGAAGTTCAAGTGTTGTCAGATAAGCAT
AGAAGAAGGCAAAGGGAAACTCTGGTGGAATTTGAGGAAAACATGCTATAAGATAGTGGAGCAC
AATTGGTTCGAAACCTTCATTGTCTTCATGATTCTGCTGAGCAGTGGGGCTCTGGTAGGTGATG
CATGATCCACTCCTTCACCTTTCATCTGAAATCTTTTCCCTTTCCCTTCAATCAACTCATATTA
CCCACTTTTAAATTAAGGTGTTTGTAAGAATGAGAAGAAATATGTGTGACGTGTTTAGCACATA
TGAGAGGCTTAGTAAATAGCAATTTTTGTCACTCTGTCTGGAGTAGCCCTCGGGTGGAACCAAA
CTCAGATCATTATGGTTTCTTATAATGTTTAAAGAAGGATCTTTCTGACTTTCAGTCATCAGAG
GCAGTTCTTATTAAGACTGGTTATGTAGACATGATGTAGGATTATCAGCTAAATATCAGACTGA
AGCACGATATTTCCCTGACCCCTTTGCAGGTGAGAACTAGAGTGCATGGGTGCCGGTAGGAGCG
```

FIG. 6 (cont'd)

```
AACTCCACTCACTCACTGCTCCACCCCTCACAGGAGGGGGAGCGCAGGTGACTGGGTGCAGGAG
CCAAGGCAAATGCATTTGGGCACTGCAAGAGTGAACTCCATACCGGCCCCACAGGAGCGTCTAG
GGGAGGGTGCCTGCGATCCTTGAAGCCCTAGAGGAAGTGTTACAGTGCCCTTTTAGCTTTGCCA
TCCATGGATGGCTTAAATGTTAACAGTTCAGTGGAGGTCAGAGTGACAGCCTTTTGCACCCAC
ACTTGTGGTACCCAAGTTCATGTCCGGCGTCCAGGAGGAATGAGTTTGTACAAATGACTTGAAG
ATGGTAAATACAGGGGATTTTATTGCCAGCGAAAGTGGCTCTCAGAGGGAAGAGGAGCTGAAAG
GAGATGGAGCAGGAAGGTAATCTTCCCCTGGAGTCTGGCCATCCCCAGCCAGACTCCTCCGA
AGCTATGCTGTCAAGCTGTCCCTCTGATGTCAAGCTACTTCTCTCTAATGTCCAACTGTAGTCT
CTGATGTCCAGCTGTTCCTCCTGTCTGCCTGCTGAGTTCTGGGCTTTATATAGGCACAGGATGG
GGGCAGGGTGCACCATGGGTGGTTTTGGAAAAGGCAACATTTAAGTGAGAAAACAGGGATGTAT
ATTCTCACTTTGGGCCACGGTTCCAGGCTTGAGGGTGGAGCCCTCGCCAGGTACCCGTCCTCTT
CTGCCCAGAATTTCTCTGCCTCTTGTTCCTGTCAAAATTGCTTAACATAAACTCCATGCTGCAG
GGGACTCCTCTGTCTTCTTCACACTGATTCGCTATTGCCAACCACAGTGAATGATAAGAAGTAG
ACTCACTTAATTACTGACTAGCAAAAAAATGATGGCATTACAAACTTATGTCTGATTTCATTCA
ATGAAATGATCAACTGGATCAAAATATTAATATAATGAAATGATATGACCTATTTCTTAATT
GGTGATACAAATGTGGTTGCATTCCTTTTACTGTTTCAATTTAATTAATAACTAGAGTGTTTGG
TGAGTTGATTTCATTAGGAGAATTACTGCATTGGATCTGGAGGCCTCTAAGGCGAATTCTGATT
TGACTAAGAATCCTGTGTCCTGCCATATACTCAGTTTAAAGAGGATCAGCCATGCTTTATTTTC
TTTACCTTTATTATTATTATTATTTTTAGACAGTCTTGCTGTTGCCCAGGCTGGAGTGCA
GTGGTGTGATCTCGACTCACTGCAGCCTCCATCTCTTGGGTTCATGCCATTCTTGTGCCTTAAC
CTCGCAAGTAGCTGGGATTACAGGTGTGAGCTACCACACCTGGCTAATTTTGTACTTTTAGTA
ATAGAGACTGGGTTTTGCCATCTTGGCCAGGCTGGTCTCGAACTCCTGGCCTCAAGAGATCTGC
CCGTCTTGGCCTCTTAAAGTGCTGGAACGACGGGCGTGAACCACCGCACCTTGCCAGACATGCT
TTCTAAAGCCAAGTAGAGAGAGAACTATGAAGTCTCATTAGTGACTAGTACCTTTGCTGTAGGA
GCTCTTTGTTCTCAGTTACACCCAGTCAGTGCTCACCAAATTGCACAACGTGCTGGCACAGTGG
CTGGCTCCTCAGGGGTTTACAGCTTCAGCTATAAGCAAAGCCCAGAAACCTTTAGGTCCTTGTA
TGGAGCTCTGGTTACAAGCCCTGATTCTTGTTATCTAAAAAGAAAATGTTCCTTTGTCTTTAA
TCCAGGCTGCCAGGTTTTCCTGATAATTTTCCGATAAGAAGATCAAGTTAGATAAATAGTCTT
TTCATTCTGGAAGCCTCAGGAGTTCCTGCAAATGAGTTACCCACTCTTTCCCAAGGGCTCTGGA
AAATTCTGTCAAAGGGAATTTCCAAACGTACACCCACCCGCCTCCACACACACACAGACACACA
GAGAGAGGGAGAGAGACAAGAAAGTGAGCAATGACAATCCTTTCCTTTTTCTGTAGGCTGAGGG
ACCTCCCTGCTTTATATCTGCATTACTAGAGGATGCATTCCATTGAGTCTGCACTGAATGAGAC
CAATCTACTCCCAGGCGTTCCACTGCCTCCTGATGTAGAGAGAAGCAGCTGGCAGTCTCTCAAA
AATTTTAAGCTCTTTGGGGGTACACTGAGACCAAAATTTAAAAATTACTGAAACCCTTGGTTGA
CTGAAATGCCCAGTCAGCAGTCATTTATGATCAGATAATGATAAAGTAAAATTCAGCCATGGGA
AACATTAAACCTTCCAGCCTTAGGCACCTGATAAGAGCTTGCATCGTTTCCTTTTTTAAGAAAT
CATCAATTAGAGACTGTTTCTGATCATAAAATTTAATAGAATTTTTTGACTTACAGGCCTTTGA
AGATATATACATTGAGCAGCGAAAAACCATTAAGACCATGTTAGAATATGCTGACAAGGTTTTC
ACTTACATATTCATTCTGGAAATGCTGCTAAAGTGGGTTGCATATGGTTTTCAAGTGTATTTTA
CCAATGCCTGGTGCTGGCTAGACTTCCTGATTGTTGATGTGAGTATGCTGCACTTTGCTGCTTT
ATTCATTGGCATATATGTAATAGTTCTAGCAATGGTGCCTGACACAGTGTAGGCACTCAGTAAC
ACTGTATCAGCCCAAATATAAATTATGTTTCTCATTTCACAGTGAGAGGATGCCTCAAAACATT
TTTTACCAATTTAAATACATATACATTCATAGATAAAAATCAAATGCCATCATACTATACTTAT
TCACTTAATTTCAAATTAATATTTAAAATCTCAAGTTATGCAAAATAAAATATGAATTTAGAAA
TTTTGCTTTTTGCACACTCACATTTCGCAAAATAACTTGTATTTAAATTTTTCACAGGCATCTT
```

FIG. 6 (cont'd)

```
TGACATTAGTATGTTTGTCATCACTAAAGCCTGTTGAGTTTAGGTCACACAGATGAATCATTAA
TTACAAAGAAATTTGAAAGTCCAAAAAGCAAGAGACACCACTTGATTTGTATGATATAGAAGCA
AATTGGCTATTGACCAAGTAGCCAAAGATTTTATTAAACCACATTGGTGTTGAAATAAAATAAG
ATAGAGTACTAAAATATGAGGGTTTTTATATAATTGAATATGAGGCAAATCTACCATTAAATGT
ACTACTACTATTAAATGTATAAAGGTTACATGCAGAATTACATTAACAGTCTCTGGCAATAAAG
GAAGACAATAAATAATATTTAGAACTACATAAGTGTGGACATTACAAACAATAGAAAATGCACC
AAAACTATAACCATTCTTTTATTTGTATAATGGGATTATGCATGATACTATTTCTTTTCTCTAT
TTTCTGTATGTACTTATCATAGGTTGGTAAATCCATAATAAAAATATCTGATACTTGATATATC
TATGTTAGGATAAAAGTATCAAGTCAGCACTGCTTGAATATAAGGAAACTCTTCAGAGAAATCT
AGTTGTCCTGCAGCTAATGATCATATTACCCAAAGTACTCTGATATTTACCTTTTAGATTTAA
GAAAACTATTATGATAGTATATGAAACTGATCAACACTTTGCCTTAAATCAAATATGCTTATTG
CTCATCTATTTCATTATGAAAGATACAAATATAAATAAGTCATTTTTCTAGTCCTGCAGTAGCT
TACAGTTGAAAAGTGAGGACAGCTGCGTACACAGTAAGTCGACACCTGTATTACAAGTGCCACC
TCTTTACTTGAGGAAGGAGGAAAGGCTTCAATAGGGAAGTGGAGTGTGAGCTGGAGCTTGAGAG
ATGTGAATGCTAGCAGGCACAGCTGAGGGAGGAACACGGATTCGTTAAAACGTTGGTGCATGAC
ATGCAGGGCGGGTTCCAGAAACAAGTAGATAGGGTGAGGTAAGCCTTTGTAATGGGATGATAAG
GTAAGAAAGATAAGTTAGAAAAGATCTGAAGAACCTGAGATGCCATCCAAGGAAATTTGGACTT
ATTATTTAATACAGAGGAAGCTATTGAAGAATTACATATAGGGAAGTGACAAGACCTGCTTGTT
CTTTTAGTGAGGGAAGTTAGGTGGAGGTGAGAATGACGGAATAGAAAGGAGATTTATTTAGAGA
TCAAAACACCAATTAGGAGATTGCTGCAATGTCCCAGAAAGAGAAGGCCTATATGTATCTTCTT
TTCCACATTTAGCTACACAAGTCACATAAAACTGAATATTTTACAACTTCTTTTCAGCCAGTAA
ATACTACCCCATTCAAAATATTTTCCTCTGTCTAACTTTTATCTTTCATCCTTTAACTTATGCT
TATCTCTTTTTGGTTCTGTCTTCAGAGAAGGTAAAGTACTACAGGTCCTTATATCTTAAATACA
GAAAAGCTTCACAACTCATGATAATTCAGTAACTATTTTTCAATTATCTGTTAAAAAGGGACTT
ACAAAGCCTAAGAGTTTGGATTTTAAGGGAACTATATGAACTATGTAAGACATAATTTTACAAC
TCATTGTTTTCTGTATTCAAGAGGCTTCACTTTCAAATTGCATGTGCAAAATTATTTTGAATAA
GTTGTTTTTTGTAACAACTTTCAATGTGCTTCACTTATTTTCCTTAAAAAATATATTTTTCAAA
TATATTAACACCATACTCTTAAAAGCTGTATTGCATATTTATTTTTATTTATCTGCTTTTGAAA
TTCAGGTGTACTTTAGAACAAAATAGCTTATATAATTTTAATAATTTTTCTATATGTTTTCAAG
GAAATTGGACATGTGTATGTCCCCGACCGTTTTTCTTTTTCTTTTAGCTAAGACTTTATAAT
TTTTCTCAACTACATTAGTCAACTGTATGAATAACTAAAGACAACATTGTTCTTGCAATTTCTA
ATTTATCATAAAATCTCAACTTTTTTTATTCACTAATTTTGTCTGACCTAATTAATGATATTAT
GCCCTTCAAACTGAAATTTACAAAAGTCAAAGCTGCTTTTTAGAGGCCTATTCCTTTTTAAATG
TGTTCATGCTCATATTCACCAGTGGTTTGTATAGTTTACTTGTGTATCAAATGTTACTTTCCAT
TTCAGATCTGCTCAATATTATTAGAAATGATACAGAAATAAGTTTTACAGATCTGTAGAGGAAG
ATCACATTTCTCTCTCTTTTTTTTCTTTACTTTTAATTTTTTAAAAACATTTCCTACCAAGAAT
CTTGAAAAGAGCACATATATGGGCTTCTTTTTATAAGTGTTCGCAGACTAGTATCATTAACT
TCACCCTGGGAACCTGTAGAAATGCAAATTCTTAGGCCTTTCCCCAAACTTACTAAGTCAGACT
CTGCTATTGGTGTTTTTAACAAGACCCCTGGGTGATTTTGAAACTCATGAAAGTTCGAGAATTA
CTGATTCATTGCATAGAGCAAGGCTGAACTGTGTAGACATTTTATATGTAAATAAGAAAATTG
TGTTGCTTTTTCTGTATAGGTCTCACTGGTTAGCTTAACTGCAAATGCCTTGGGTTACTCAGAA
CTTGGTGCCATCAAATCCCTCAGAACACTAAGAGCTCTGAGGCCACTGAGAGCTTTGTCCCGGT
TTGAAGGAATGAGGGTAAGACTGAATGCCTTAGAGTTTGTCAGAATTATTATTGAGAGCAGACT
GACACTTTGTACCATGGAAATGTCAAATTTATGGAGAATTTGTGTCTTACACATTCATACTGAC
ATAGCTAATCAATCAAAAATAATATTTACCAGATGCCCATAATACTTGGCACTGCTGGAGTCAC
```

FIG. 6 (cont'd)

```
TCACAGAGTAGTATATTGCCAGAGGGATTGTTTCTGATTAGCTAGATTTTCACTTCTTGGAAAA
TCTCTATAGTTATGCTGCTGATTTGAATCAAGATTATTTATGTTCACTTCATTTATAAATGTGC
AGGAAATCCTACTCGCTGTAGTTTAAGCCTACCAAATCATTGCTCATCATTTCTTCACTACTCC
GCTGTGATACACTTTGAGCCTTTTGATGTTTGAATCAGGCCTTTTAGTTCTTAAACACAGGCTG
AAATGGCTAAAAAGTAGGTCAACTGGAAATCTAACGCTCATTTAGAAGGGTGGTACAAAAGAAC
AGAGGAGTTTGTGCTGACATTTGTCGTCCCCTGAGGCACAAAACCTGAGACCACATACCCTCAC
CACCTAGAAAATGATGATGCCTTGTCTCAGTTGTTTTAGCTGGTTCAAAGAGGATTTTAAAAAA
ATGATACTTTTGTGATATTTGAAATAAGTTGCTTAGACTTTATCTGCATGTTATAGTGATAC
TAGCTCATATTTTCTAACTAAGAAAATAGTTACTTAGACTTTATCTAGTGTTACAATCACAACT
AGAGATGAATGGTGTGTGTAGATGTGTGTCTGTATATGCATGGTTACATAGAAAGTGTTATTA
GCGGTAAAATTCTTTTTACTTTACCAATTAGAAAGAACAGTTTTTGCAGTAGAAGGCTTAATAA
ACAAAAGGTATCAATCTTTCAGTACCAGAATACTGTTTATATTTTCTGTGTGGAATTTGATCCC
CAAGTGGTCTCTTTTACTCTCAAATTTTGGACAGCAAATTGTATGGTTTGTATGATTTTTGAA
AGTGATGTTCACTTCTATATTCATGCCACTGTTTATACTCTTAATTATTTTGGCATTTGCTGT
TAGTTCCATCCTTTGAGGTAAATTTGCTACATGTGTGTTATTACCTCTTGAGAAACATTCTCC
AATATAAAATTCGTTGTATACTCTTCTGATTTATAATTTTAAAATTCTTAGTTGGAGCTACCAG
AGTCTAGTTTCTACCCAATATTCAACTTTGAAACAGATTTTTTAATCATTTGACTGTTCTTTT
AATAATGTTTAAAAATAAGTAAATATTTGTTGTTGGCTTTTCACTTATTTTCCTTCTCATCCT
GTGCCAGGTTGTTGTAAATGCTCTTTTAGGAGCCATTCCATCTATCATGAATGTACTTCTGGTT
TGTCTGATCTTTTGGCTAATATTCAGTATCATGGGAGTGAATCTCTTTGCTGGCAAGTTTTACC
ATTGTATTAATTACACCACTGGAGAGATGTTTGATGTAAGCGTGGTCAACAACTACAGTGAGTG
CAAAGCTCTCATTGAGAGCAATCAAACTGCCAGGTGGAAAAATGTGAAAGTAAACTTTGATAAC
GTAGGACTTGGATATCTGTCTCTACTTCAAGTAGTAAGTAATCACTTTATTATTTTCCATGATG
TGTAATTAAAATGAGTCTAAAGTTTTTCTTCCTCATAATGAGATATCCACCTGTTAGAATGGCT
ATTATCAAACAGATAAATGACAATAAATGCTGGCAAGAATGTGAAGAAAAGGGAACCCTTGTAC
ATTGTTGGCAGGGATGTAAATTAGTATAGCTTTTATGGAAAACAGTATGGAGGTTTCTCAAAAA
ACTAAAAATAGAACCACTATGTGATCCAACAATTCCATTACTGGGTATATATACAAAGGAAATT
AAATCAACATGTCAAAGAGATGTCTGCACTCTCACACTCACTGCAGCACTATTCACAATAGCCA
AAATATGGAAACAACCTAATTGTCCATCAACAGATATGTGGATAAAGAAAAGTGTGTGTGTGTG
TGTGTGTGTACATATATGTATATGTATATATATACACACGTATTTCTATATACACGTA
TAGATATACACTGTATATGTATATATCTATACACATATATAGACATACACAGAAACAGTGTTTG
TGTATGTGTGCGTGTATATAGAAGTAGTCAGGGAAGGGGCAGAGCCTGTGGCACTAAGAAACTG
AGAAAATGTACAAGACTTTTGTTTTCAGAATTACTATGTCCGCACAACAGAAAAGTATTTCAA
AAAGTAAATGCGCTTGAATGTATTTGTTTTCAGTTAGGAAACTGCTTCTTTTTGTAGAGTGCC
TTAAAATAGTATGTTCAACAATATTAAAAGATTTTCAAAAATAAGCCCTCGTGATTGATGATT
GGTAATAATCATTTAAAAACTTATTGGATGTATATATATGTGTGTATACACGCACACACA
CACACACACCCTATAGACATACACAATGAAATAGTATTCAGCCTTTAAAGAAGAAGGAAATCC
TGTCCTTTTATACAACATTGATTCACCTGGAGGAAATTAAGTGAAATAAGCCAGGCACAGAAAG
ACAAATGACACATGATGTCACTTATATATGGAATCTAAAAAACACAAACTCACAGAAACAGAAA
GCAGAATGACAATCACCAGGGGCTGGGGATGATGGGAGATGTTGGTCAAAGGATACAAAATTC
AATTCGACAGGAAGAATACATTCTGTAGAGCTATTGTACAGCATGGTGACTATAGTTAATAATA
ATATATTATATACTTGAAAATAGCTAAGTGAGTAGATATGTTTTCTCATCAGAAAAAAATAAGT
ATAAGAAGCGATAATTATATATTACTTAGCTTGAGTTAGCCATTTCACAATATATATATATTTG
AAAACATCATTTTGTACAACATAAATATATTCATTTTATTTGTCAATTAAAAAATGAATATAT
TTTTGAAAAGCAATTAAAATAAAAATGCATATACATTTTAGGAACTCTATATAGATGCACTAAA
```

FIG. 6 (cont'd)

```
ACTATATAAAATGATATAATACTATACAACAATAAAATAAAATTTTTCTTCCTCTGTGTTTAC
AAATACTTCCTTAGGCCCATCTGCCTAGATTCCTCTTACCATGATTGAACTATCTTTTCTGCCC
CACGCTGGAAACATGATGGTTCTAAAAACTTTATTGTCTCCCTGACTATGCATTTGGTAGCATA
GCCAAGTCCTTTGTTACTGGGAGTTTAATCTAGGCACTCATTGTTTTCCTCCCTTCCTACTCTG
AGGAAAGAAGTGCTGGCCCCAAGGGGGGTTGAAAAGGGGTGTGTGTGTGTGTGTATGTGTCC
ACACGCGTGTGTGTAGATAGAGAAAGAGAGAGAGACTTTCAAATAGGAAAATTGCTCTCTTGCA
AATGAAAACTTTCCAATTAAGACTATTGTGTCTGCTATGCACTCATAATAATTCATTCAGCTAT
TCAACTGACTGCAGTATTAAATCTCCACTAGCTCCTGGACACAATCCACTTACACGATCCTCAA
GACTATTAAAATAGTCAGGAAAGGGGAAGAGCCTGTGGCACTAAGGAACTGAAAAAATGTACAA
GAGTTTTATTTTCAAGATCATTATGTCAACGGAGCAGAAAACAAATATTTAAAAAAGGAAATGC
AGTAGAATATATTGTTTTCAGATTAGGAAACTGCTTCCTCTTATAGAGTAATCACCTCAAAATA
GTATGATCAACAATATTAAGAAGATTTTCAAGAATAAGCTGTCATGATTGGTGATTGGTGTAAT
AATCATTTAGAAAAGAATAAGTAGAAAGGAAGCATTAAGATAAATAATGCAGCATACTTTTGAG
CTTGTCTCATGCTGCTACTATACACATGAAATTTTTTCATCAAAGTTCATGATATATTTTATA
TAAACACATCAGAGTCAAAGATTGTTCATATTGTTTTATGATAGCATATTGTTACAGTAGATC
ATTATTTAATTATATATGCTAAATATCCACATAAGATGTTATAGAGGAATATAAATTTGAAGTA
TTTTCAATGCATATCGCAAAACATTGCCCCAAAAGTGAATACAAATTTCAAGCTTATTTATATG
CCTGTATTGAATACATGTCAAATAGAATTTTGATCAATTATTCAATTTATTTTCTAAAATTATA
ATTTTGGGAAAAAGAAAATGATATGACTTTTCTTACAGGCCACGTTTAAGGGATGGATGGATA
TTATGTATGCAGCTGTTGATTCACGAAATGTAAGTCTAGTTAGAGGGAAATTGTTTAGTTTGAT
TAAATGTATATTTCTACAATATTGTAATTTAGTGATATTGTCAATAAAATAAAATTATGTGCTT
AATTTATAAAACCCATCTATATTATAAGGATAAAATATTTAATCATACTATTTCTTTCAAAATT
ATCATAGGATGATTTTCTCTAATCACTCTGTATCTTTTAACATATCTTTTCTAGTATTTAGCAA
GGCACCTGACACAAAACTTTATTGTATGTATTTTCAAAATGAGACATTTTATTTTGGCTCTGA
TAGTCCTGGTCATTTGTGCATTAGAAGTTCTCACAGGCAATATTTTTTATCTGTAATATATTTC
CTCCAGCTTTTGATCTTCCTTATAATAGGAAGGATATGACTAAAAACGGGGACAAAAATAAACA
ATTTAGTGTTTCTCTTGGGAAAGTGAGATTAAGTGGTAGAAGGGAGGGACTTCCCTAATCTACT
TTATACATACCAGTACTTTGAATTCTTTTCTATAATTTTCATTAATTTCTCACTATTTAATGAG
GAATGAAGTCACATTTTGAAAAAAAAAAAAAAAGAGATTGATTTCTGGTATGCCAGAGCATGAT
AATAAAGCTCAAAATGCTCTTTCCCTAGCACCAGCAGCTAGCTTTCTGAGTGAAGAATTCCTGA
GGTTTTTTTTTTCTTTTTCCACTTCATAAAAACAGAGAGGGAGCAAGAAAGCATGAAAAGCC
CTGCATTGTATCTCTATAAGTGCTATCAGGAATTCCAGTTATGAGATTTTTCTGAATAGTAATA
ATAATTTATTGATTATCACTATTCACTGTGCCAAGGACTTTCTCACATTATCCCATTTAATCCT
AAATGACAACCTTATTGTATAGGTGATACTAGCTCTATTTACTACTGAAGCAAAGAGGCTTAA
TGCGTTAAATGGGAAAACAAGTTTTTGAACCCTGACCACAAATAATGGCTCATACCCACTTTCC
ACAGTGGTTCTTACCTTTTTGATTAATTAATTCAATGCTCTCTCCACCTTCCTTATCAATAGCT
TATATGCCATGAAACATTTTCAGTTTCTTCTTTAATAACTTAGCAGACCTTTTCCGCTGCAAAA
CTCCTGGAATTTCCAGCACATTACAAAAGATGAAAGCCAATTGAGCACTACATTTATGAAAAGT
TGCTGGATCTTGAACTTTAATTAGTAAATTGCATCAGATAAATGCAAATTTAAACCAAAATAAA
ACATTATCTACACACCTACCAGATTGGCAATACCAAAAGTCTGACAATACCAAGTTTTACCAA
GGATAAACAGCAATAAGAACACTCGTACAATGCTGATAGGAAAAAAATAGTTAAATAATCCTT
TAAAAACAGTTGGGTATGATCACATTATTTGAGAAAGTTAAAGATATTTTTAATACTGCAATT
CTACTTTGAACAACGTATCCTAAAGAAACTTATGCACATGTTTAGGATAATCTATGTACAAAAA
TGAATATAACTTTTTTTGCACTTGCAAAAACTGGGAGCAACTCAAAACAGTAGAAATAGGC
AAATAATTGAATACTATATAGTGATGAAAATGAATGAATACCGCCATATACAACCACATGGATG
```

FIG. 6 (cont'd)

```
AGCCTTAAAAATACAACATTGAGTTAAAGAAACTAGACACATACTATAATTCTACTTATATAAA
GTTCGAAATTGACAAAACTAAGCTTATTGTTCAAAACTGCATACTGAGGTGTTAACTTGAAAGA
AAAGCAGGGACATCATTACCATAAAAGTCAGGATAATGATTACCTCCAGCAGGGATGATGGAG
TTTATGTTTGAGAAGGGTACACCAAGGGTTTCTGAAGTTGTAGCAATGTCCTGGGTTATGGATT
TCACTTATAAACATATTATATTTTGCATTTATGTATTATGCACTTTCCTGTATGTATATTGTC
TTTTAAAAATTTTAAAAATATAATTTTACATCACTGTTAACTAAACTCACATACACAAATAAAA
TCTCATCGAAGAATAGCAGTTTTACAATATTCCTGATATTTTCCATTTGCTGTATTTCCTTAG
AAACAAAATTATGCTGGTCATAATCCTCTAAATTGATTTCATAACACAGTGGGTTATAACTTGC
ATCTATTATCATCATCAGGGATTGGTTAACTGAGTTGGTTAGAACAATGTCCTATTAGACCTGT
GAAAGCTTACAGCTAAGGCGCAAACCTACTATCACACAGTTTTCTAAACAAAAGTGGATTAGAC
AAGAGATAGTATCATTGTTACAGAAACAGTCCCTACTGAATAGGATAAAGCAATAGATTCATTT
TCAGAAAGGAAAGATCAACCTATATACCTACATGCAGACCTACTACAATGATTCTTGCCTATCT
AAAGAAATGTATTATACCAAACCCTTACACTTAGCAATTACTACTGGCCGCCACTGTTCTAAGC
ATATTTATATGTTAATATAGTTAATCTTCACAACCACACTATGAGGTTTAAGTTTGATTATTTT
CATCTCACAGATGAGAAAACTGAGTCAGAGAAAGTAAATCTTAAAAGTTTTGACATAGAATAAT
GTGACGCTGACATCTCTTTTGTAAGAAGAGGAAATCTTTAATTTGCATGCTGTGTTGGGAACTT
TGCTTAGAAAGGAAAGTGCATTCATAATCTGGGCATTTGTTGGGTGAAATTGTCTATAATCATT
CAGACTTCTATATGGTTATTTCATTTTCCCAGGTAATGAATAGTCTTGCAGAACTCTTCAATAA
GCATGTGAGATTTGAAGGTTCATAAAATCTGTTTAGTGTTTGGTTTATTTTCATTCCAGAGATT
AAAACATGCTTAGATAATTAAAAACTCACTGATGTACTTTTTGTGAAACAAGTACTAGATATAA
TGGTTACAATTCTTCATATTCTTTAGGTAGAATTACAACCCAAGTATGAAGACAACCTGTACAT
GTATCTTTATTTGTCATCTTTATTATTTTGGTTCATTCTTTACCTTGAATCTTTTCATTGGT
GTCATCATAGATAACTTCAACCAACAGAAAAGAAGATAAGTATATTAAAACTTCATCCTTGCT
CTGAAATATGAACTAAATATTTCATACTCTTTCCTTTAGCCTCCAAAATGCAATCACCAAAAAA
AGAATATAAAATTCAGAAATTATTTTGAGACATTTGATAATCGATAAGCTTTTAAGCAATTAAT
AATTCAGATAGCATGTTTTGATATTTTAGTCTAGAAATATGACTAATATGGCATAATTTATA
TATTGAATAAAGGCATCTCTATAAATACAGATATTAGTAACAATAGAATGAAATGTGGGAGCCA
ATTTTCACATGATTACTAAGGTGGATTTTATAGCCAGCAAAGAACACAATTTTAACAAGTGTTG
CTTTCATTTCTTTACTTTGGAGGTCAAGACATTTTATGACAGAAGAACAGAAGAAATACTACA
ATGCAATGAAAAACTGGGTTCAAAGAAACCACAAAAACCCATACCTCGACCTGCTGTAAGAAT
AACATATTTTCATTGCCTGTTAAAACTATATTACCTAACCGTTTCACAGCCCGAATTTCTAGAA
ACTAGTTATTTTGTGGATTTGTAACACAAAGTTTTTTACCTTAACAATGGGACTAGCTAGCCT
AAATAGCTTGAAAAATGTACTTTACATATATAATATGTATAAATTATATAATGCATAACATATT
TTATATGTAAACATATAAAATACATAGAAATAAAATTTGCTATACTTAAGTGCCAGTGGTATCA
TACAAGCTGATGTCATTAAGACACTTCTAATAACATCAAAAATAAAATACATACATACATAATG
TGAAAATATTAAATGTTCTCAGAGTACAGAGGAGACAGATCGGAATAATTGGTACGTCACAGAT
TGGCCTCAGTTTTGTCCAACTCTGCAGATTGAATGGAATCATTAATGAAACAGGCCACAGGTT
TTGCTTTTTTCTGGTTAAACAAAAAAAGACAAACCTCATATTTTCCCCTACTATCCCACCCTT
AAATGAGATGATATCATTCTTTGTAGGGCTTTTTATTGGCTCTTCCAGGTGTACATTTGCCAGT
GATACTGTTCGTTCAGTTTGGCTGCTGCAGGGAGTTGCTGCCAGGAGAATCGCTAAGTTTTCT
ATCACTCCTGAAGGACTAGCTCATATATTAAGTCTCAGAAAATCTTCCCCAACGTATACGTGGT
ATAAAACACTTCAGTGTTTCTCAGAAATCTTGACTCTATAAATCTATTGGTGACAATATAAAAC
AGACCGTAATTAAGTGTTCAGTTGGTAAGCCGGCAATAACTCAAAGAAAATGGATAGCTATAT
TGGGTCAAACACAAAGGGTGTACAACTTGAGCCTAGTCTTTAGGAAATAATACAATTTGAATGA
ATAGAGAGAGAAGCAGAGAACATTTACTGTATGAGAAAATGTATACTTCATAGCCATATAGACA
```

FIG. 6 (cont'd)

```
AATATATCAGTGCAGAATAGTGATGCATTTGAATTAGTGAGTAGTAGACACTGGTTTTCCGAGT
TACATGAGACAAGGTTACCATACGAGTCTGAAGAAATTTGTTCTAATTAAGCAATACAAATGCA
ATATAGTTAACAGAACAGCCTAGTAATGTGAAAAGAAAGATTTTAGAGAGTTTAACCTAGAGAC
TGGTGTGGAACAATATTAGAGGCAAAATAACCCTCGGCCATAGACAAGAAGATAAACCCTTACA
TACAAGAAGATAGTCCATAATCTGTGTCCAACCAGCAGGACTGGAACTACTCCAGGAGTGAAGT
TAGCCAATAAGAAGACTCAATTGGGATGAAACACAGGAAAAGAGGGAGGATGCAATGAAAAAAC
TGGGTTCAAAGAAACCACAATAACCCATACCTCGACCTGCTGTAAGAATAGCATATTTTCATTG
CCTGTTATGAAACACAGGAAAAGAGGGAGGATATGTAAATAACAGAGAATCTAAAATATAAGCT
AGTTGATATTTTGTGAAACTGTTGGTTCCACTATCATATACTGAAGTCATATGAAGGCACTGGG
AAAAATAGTGTTAGAGCCTATGAAATGTCCAGACTGAAATAAGGATTTTAGCATTGTCAGAACA
AAATTCAATTGAGCTCTGAAACACAGATTCATTTTGAAAATAATTAGAATAGAGAAAAAAC
AAAATTCTCAGAATGAGGCCTTGCATACTTCATCAAGATATAGGAAGAAATAAATCAATGAAGA
AATGAGCTTGAGTTTGTTTCCATCAAATGACATGGATTTACCTGTAGTGGTAGGGTGTGTGGA
AAAAGTTCAACACATTCAGCTAGAATATTATCAGTGTCAATTTGGCAATTTAGCAAGTAACTAG
TAAAATCCATTTATTCCTGCATTGACAATATGTACTATGTAGTATGCTAAGCATTTGAACTTAA
ATATCGAACAGTATGGAGTCTAGTTAATGCAACGGATAGTAATCAAATAGTCCTGCCAAAAAT
GGAAGTATCCCAGAAAAAAGGGATACTTTCAGCTGTGAGAGCTGATTAGGGGGAAGGGGCTGA
TTAATCAGGGAAGTTAGGGAAGGCTTTATTAAAAAAATATACTAGCTGAGGATGGAAAAAGAAT
AGAAAGCATCAATAGCCAGAGTGGGATGAGAAGAGCCCTGTAGAAGGGGAATGAATTTGTGAAG
GTCCTTATGTAGGAGGGCTGGTGAGACTGGAGTGCAGAAAGTCAAGGTTCATTTGGGACACACT
GAGAATAAAGAGGTTAGGATAAGCCCAAACTTTTCTGGGCCTTGGAGGCCGTGTTAAGGAGTAG
TTTTCATCCTAAGAGCAGTAAGAAACCGTTAACGTGGACCCAGTCAGTCTGGGCTTTGTGGTGA
TCACTCAATCAGTTTCACAGAGGCCGTGTGAATACATTGTAGACTTGTTTTGGAGCTATTTCAG
AGATGGTAGGTAGCCTGAACCATAGCAATGTGCAGATTAATAAAAGTGGATGGATTTGTGAGCT
ATCACCAGAGTGAAATTTAAAAGTTTGTCTATTAATTGAATATGGGAACTAAAGAAGGAACCAA
CAAGAATGACTGGTGTCTTTCTGCTTTGCACAACTGGATAAATACTGATGTCATGCAGGAAATG
AAGAAGGGACAGAAAGTGGTGAGAAAATTGGAGATGCTAGTTTGCAGAATTTGGCAAACGAGTC
AGAGTGAGAGAGTGAGAGGAAGGAGGAAGGGAGAGAAATGATGAATATTTAGAAGTAGCAAAAT
AAAGGTTTCTTAAGATTCAGAGATTAGGTTTAAAGGAAAGCAAAAGGAATTTTAGAGAGGAAAA
GATCGAAGACAGAGGGAATAATTACGGCATAAAAATGCACAAGATGTGGGACAAGGACATAGTG
GTCTAGGGTAGCTTTAGAAAGAAAAAGGGGCTGAGTCCTCTAATGAATTTGGAGTAATATATGA
AAAGAACATGGAAATTAAAATAATATGAAATGCAAAAGGAAACAGAGGAGTTTATTTAAACTGT
TTAAATTTAATGTTCTAAAAAAGTAAAATAGAGGCAAGAGAATGGAAATTTATGAGAAGTT
TGGAATTATCTTTGGAGCAAATGAAGGACAAAGGATTGCTAATTGTAAATCTGAAGGGCCAAG
ATGAAGTTAGAGAACATAAATTTTTGGTGAATAAGATCTTCAGAATTATACATCTTGTTCCAGC
ATATTTGACACCCTAGGATTTAAATGGGAGAACAGAACACAGAGACTCGAGACTGGAGTTGTAC
ATTGAGATGTCTGTCTCATTGGACAACTCTATGAACAGGGAATCTAAACAGTTTTTATTAGTC
ATGGTGATATTAAAATTAAGACCAAATTTCTGCTTTTAAGATATTTTGAACTTACTATACTCTA
GGAGCCATATCTGAGAGAAAATGATACTGCTCCTGCTTTTGAGGGGCCTCAAAACAAGTGGAA
GGGAAAGAAAACTAAAATTGAATAAGAGCAAACCATTTGCAATACAATGCCATACATTTTATGA
TCAATGAAAGCACTCAGTTTTCTGAGAGCACTAAGTGCTTTAAACTCAAAACTGAGTTAGAATT
CATGAGACAGAGAAGGAGTGGGGACATGTGTTTTAGACAGAATAGTAGACAGATAAACTATGT
AAAATGATACAGTAGAACCTGCCTAAGCTTCTAAGAGTGGTAGGCAGGAAATATCAGAGGGTGG
AAGTAAGGGGAAGATGCCAGACTTGGAAAGTTAAACTACAGTAAATTAATAATTAATAAGGAAG
GGTTTGAACTAAAAGTAGACACATTTATTGGGTTGAAAAAGGCCCTGAGAAGACAGATCCAGCT
```

FIG. 6 (cont'd)

```
GGAGTAATAGAAATCTAGTTCAGCAGGCCAAATACGCATTCAGAGAAAAGAGCAAAACAAAATA
GAACAAGTAGTGTTTGATGTCCAAAAATCACCATTGGAAGTAATAGAAGCCTCCCAATAGAAAG
AGGGCAGAACACTAAGATGTAGAATCCAGGCCACTAAAAGTGTCAGGATCTGGGAAAGCAAGCC
ATTAGGTGTATATGTAGCAGAGTATTAGTCATTCTAGTTGAGAAGGTAGAGAAAGGCAGCCCAA
CAGAGGTTAAGTCAAGACCAGATCCCTAGATTACCTGAGAAACAAAGCAGATACGTGCAAAATG
GAACAATACAGAAACCAATGATCAGAACTGGTTTACAAGTTGGGGACTTCATTTCATAAGCAAG
ACATAAGGCAATTAGTACTTGGAAATAAGGTCCAAATAGACTAGGGCAAAGATTGAATATTTCC
ATTGTGACTTTTTAAAAGATAATTTTATTCTTACAAGAGTTACTCATAATGAATACTCTAAT
GAATCTATACACAGTGTCCTCTTGTTTTAACATCTTATGCAACCATAGATCAGTTCTCACAACT
AAGAAATTAATCTTGATATAATACCATTAAATAAAATACAGAACTGAGTCAGATTTCACCAGTT
TTTCCACTGAAGCCTTTTCTCTAGAATGATGATTTTTAAAACATCTTAGCTGAACTTTAAAATG
AAATTTAAGATGCTGTAGCTTTAGTGAGAGAATATAAAGTCAGAAATCAGACGAAAAATTTAAA
AAGAGAGAGGAAAACTTGGAGAAGTATTTATTTATTAGTTGCTTAAAGTAAAATTAATACCCTC
CCAACACATGGGATAAAAATTTTATTACATGACAAATATTTACTAACTGTCCGTCATAACATG
ATGGTGTTCTGTGCACTGAGAACATAATACGTGAGTTTATAAAACCTGGTATCAATGTGAGTAT
AAATAAAACAAATACATTTGAATACAGTTGAATATACAATATACAAAATTTTCTTCCAAGTATA
AAACGAAAATAAAATACACTACTTTCTTTAATAGAATAGAACATTGTAATAATGTTCCATTGCA
TTTGACCCTCACATAAATGCTATGAGGTAGCATTAAGAGATAAGATTTGAGGCTGGGCATGGTG
GCTCATGCCTGTAATTCCAGCACTTTGGGAGGTCGAGGTGGGCAGATCATTAGGTCAGGAGTTT
GAGACCAGCCTGACCAATACGGTGAAATCCCGTCTCTACTAAAATTACAAAAAGTAGTCGGGCA
TGGTGGCATGTACCTGTAATCCCAGCTACTCAGGAGGCTGAGGCAGGAGTATCGCTTGAACCCG
GGAGGCAGAGGTTGCAGTGAGCCAAGATCGTGCCACTGCACTCCAACCTGTGCAACAGAGCGAG
ACTCCATCTCAAAAAATAAAAAAATTAAAAAAAGAGAGAGAGATAAGATTTGAGATCTGACA
TGGAGCTTCCCTATTTACACTACTTACCTGCTTTGTGACCTAAGGCAAGTTACCTCAGCTCTCC
AATCACTGGTTTTGCAAGGAATTTTTTTTTTGTAAAATGTTGTGAGGATTAAAGATGTGTTTT
TATAAAAGCTACATTTTTTGTTGCTTTCTTAAAATCAGAAGAATTGAATTCGATTTTTTTAAG
GTTTCTAATGGAACTTTTACATATTATTTGTTCCAGAACAAATTCCAAGGAATGGTCTTTGATT
TTGTAACCAAACAAGTCTTTGATATCAGCATCATGATCCTCATCTGCCTTAACATGGTCACCAT
GATGGTGGAAACCGATGACCAGAGTCAAGAAATGACAAACATTCTGTACTGGATTAATCTGGTG
TTTATTGTTCTGTTCACTGGAGAATGTGTGCTGAAACTGATCTCTCTTCGTTACTACTATTTCA
CTATTGGATGGAATATTTTTGATTTTGTGGTGGTCATTCTCTCCATTGTAGGTAAGAAGAGGTG
CTTTTATTCAGTTAAGGAATATAGTGGTAAAAATATGTGTTTTAAAACTTTAGAGGTGTTTTTC
ACTAATCTTTCTCATTCATCCCAAACTCCCAAATAAAAATCTAATAGTCCATTGTTTAGTTTT
AGTTTGCCATTTCTCTAATTGCATGCTGTGCTTGAAATGATGAGTGGAATACAAGGAATTTATA
TTTTCAGCTTTCATTTATTCTCATTTAATATTTTCATCTGTTCTCATCTCAGAAGACAATAACT
GCAACTTTGGTAGAATAGTCTTGTACCTGGTCATACTCCTGTGGTATTGACAGTTACTGCTTTG
AATAAACAATCAATCCACACACATATATACATAAATCATTTGAAGTAGTCACATAATTCATAAA
TATGACCTCTTAAATAATTGGAATAGTGTATATGTGCAGTTATATATATAATAACACATATATA
AGTTTCATGTTATCTTTGGGTGCAGACAGTTTTCTGTGGTTTGCAATATCTCTTTTTGGAAGCA
GATAGTTTGTTTGAAAATCCAAAACAGATTTGTTATCATCAATGATACATTAATGTTAGGATAC
ATACATACATTAAGTCCTAGGAATGCAAAAGATTTATTGGAAAAAATATATATATACAGTGTTT
ATGTATAAGATATTAAATGAGGTACTGGAAGTAAATATAAGAAGATTTAAGAGAAGGTTCTACC
TATTTGGGAAACAGAACATTCACATGGAGGGGAAAATTATATAGCACTCTTTAAACTACTTTC
TTTAGTCGAATAGAACATTGTAACAATGTTCCACTGCATTTGATTCTCACATAAGTGCTATGAG
GTAGCATTAAGAGGTAAGATTTGAGATCTGACCTGGAGCTTCCCTATTTACACTACTTACCTTC
```

FIG. 6 (cont'd)

```
TCAGTGACCTAAGAGAAGTTACCTCAGCTCTCCAATCTCTGGTTTTGCAAGGAATTTTTCTGTA
AAATGTTATTGTGAGGATTAAATCAGATTATGTATATATATGCACTTAGCACTGTGCCTAGCAT
GAAGAAAAGACTTAGTAAATGTTCAGTTTGACCACAAGAAAAAGTTGATATTATCACCATTTAC
TCATGCATAAAAGCAAGTGCCAGGATTCAGTCCCAAGTACATCTGTCTCCAAAGCCTATGTTTT
CTTCTGTACATCACGCTGCCTACTCCCAAATAACATAGAATCTCAGAAAGTAAAGAACTCTCAT
ATTCCTGACCCAAAATCATACACCTTTAGTTCTTATGCAAATACTAGAACTAGTATTTTGGACA
TATAAATTAATTTCTGTACTTGGCCACTGTATGCTTCATGATGTCTTTGGACCTTCCAGGGTTG
AGTCATTTTTTGATAGATGCTTTCCTTGAACTAGGAAAAATGGCCCTTATTATCTTCATTTAA
TATAAAGATGTAAATGTTATAACACCAAACATACCAGTTTCATTTTGCTCAACAAACATTGCAG
ATTATTTGCATATATACATGTACCTAACTGTCCTGTTCACATTTTGTAAAACTAATGTACTTAT
GTAAACTTTCATTTGCTACTATTAAGTATAACAATATTTTGTTATTTGTTGATTTTCTACAGG
AATGTTTCTGGCTGAACTGATAGAAAAGTATTTTGTGTCCCCTACCCTGTTCCGAGTGATCCGT
CTTGCCAGGATTGGCCGAATCCTACGTCTGATCAAAGGAGCAAAGGGGATCCGCACGCTGCTCT
TTGCTTTGATGATGTCCCTTCCTGCGTTGTTTAACATCGGCCTCCTTCTTTTCCTGGTCATGTT
CATCTACGCCATCTTTGGGATGTCCAATTTTGCCTATGTTAAGAGGGAAGTTGGGATCGATGAC
ATGTTCAACTTTGAGACCTTTGGCAACAGCATGATCTGCCTGTTCCAAATTACAACCTCTGCTG
GCTGGGATGGATTGCTAGCACCTATTCTTAATAGTGGACCTCCAGACTGTGACCCTGACAAAGA
TCACCCTGGAAGCTCAGTTAAAGGAGACTGTGGGAACCCATCTGTTGGGATTTTCTTTTTTGTC
AGTTACATCATCATATCCTTCCTGGTTGTGGTGAACATGTACATCGCGGTCATCCTGGAGAACT
TCAGTGTTGCTACTGAAGAAAGTGCAGAGCCTCTGAGTGAGGATGACTTTGAGATGTTCTATGA
GGTTTGGGAGAAGTTTGATCCCGATGCGACCCAGTTTATAGAGTTTGCCAAACTTTCTGATTTT
GCAGATGCCCTGGATCCTCCTCTTCTCATAGCAAAACCCAACAAAGTCCAGCTCATTGCCATGG
ATCTGCCCATGGTGAGTGGTGACCGGATCCACTGTCTTGACATCTTATTTGCTTTTACAAAGCG
TGTTTTGGGTGAGAGTGGAGAGATGGATGCCCTTCGAATACAGATGGAAGAGCGATTCATGGCA
TCAAACCCCTCCAAAGTCTCTTATGAGCCCATTACGACCACGTTGAAACGCAAACAAGAGGAGG
TGTCTGCTATTATTATCCAGAGGGCTTACAGACGCTACCTCTTGAAGCAAAAAGTTAAAAAGGT
ATCAAGTATATACAAGAAAGACAAAGGCAAAGAATGTGATGGAACACCCATCAAAGAAGATACT
CTCATTGATAAACTGAATGAGAATTCAACTCCAGAGAAAACCGATATGACGCCTTCCACCACGT
CTCCACCCTCGTATGATAGTGTGACCAAACCAGAAAAGAAAAATTTGAAAAAGACAAATCAGA
AAAGGAAGACAAAGGGAAAGATATCAGGGAAGTAAAAAGTAAAAGAAACCAAGAATTTTCCA
TTTTGTGATCAATTGTTTACAGCCCGTGATGGTGATGTGTTTGTGTCAACAGGACTCCCACAGG
AGGTCTATGCCAAACTGACTGTTTTACAAATGTATACTTAAGGTCAGTGCCTATAACAAGACA
GAGACCTCTGGTCAGCAAACTGGAACTCAGTAAACTGGAGAAATAGTATCGATGGGAGGTTTCT
ATTTTCACAACCAGCTGACACTGCTGAAGAGCAGAGGCGTAATGGCTACTCAGACGATAGGAAC
CAATTTAAAGGGGGAGGGAAGTTAAATTTTATGTAAATTCAACATGTGACACTTGATAATAG
TAATTGTCACCAGTGTTTATGTTTTAACTGCCACACCTGCCATATTTTTACAAACGTGTGCTG
TGAATTTATCACTTTTCTTTTTAATTCACAGGTTGTTTACTATTATATGTGACTATTTTTGTAA
ATGGGTTTGTGTTTGGGAGAGGGATTAAAGGGAGGGAATTCTACATTTCTCTATTGTATTGTA
TAACTGGATATATTTTAAATGGAGGCATGCTGCAATTCTCATTCACACATAAAAAAATCACATC
ACAAAAGGGAAGAGTTTACTTCTTGTTTCAGGATGTTTTAGATTTTTGAGGTGCTTAAATAGC
TATTCGTATTTTAAGGTGTCTCATCCAGAAAAAATTTAATGTGCCTGTAAATGTTCCATAGAA
TCACAAGCATTAAAGAGTTGTTTATTTTACATAACCCATTAAATGTACATGTATATATGTAT
ATATGTATATGTGCGTGTATACATATATATGTATACACACATGCACACACAGAGATATACAC
ATACCATTACATTGTCATTCACAGTCCCAGCAGCATGACTATCACATTTTTGATAAGTGTCCTT
TGGCATAAAATAAAAATATCCTATCAGTCCTTTCTAAGAAGCCTGAATTGACCAAAAACATCC
```

FIG. 6 (cont'd)

```
CCACCACCACTTTATAAAGTTGATTCTGCTTTATCCTGCAGTATTGTTTAGCCATCTTCTGCTC
TTGGTAAGGTTGACATAGTATATGTCAATTTAAAAAATAAAAGTCTGCTTTGTAAATAGTAATT
TTACCCAGTGGTGCATGTTTGAGCAAACAAAATGATGATTTAAGCACACTACTTATTGCATCA
AATATGTACCACAGTAAGTATAGTTTGCAAGCTTTCAACAGGTAATATGATGTAATTGGTTCCA
TTATAGTTTGAAGCTGTCACTGCTGCATGTTTATCTTGCCTATGCTGCTGTATCTTATTCCTTC
CACTGTTCAGAAGTCTAATATGGGAAGCCATATATCAGTGGTAAAGTGAAGCAAATTGTTCTAC
CAAGACCTCATTCTTCATGTCATTAAGCAATAGGTTGCAGCAAACAAGGAAGAGCTTCTTGCTT
TTTATTCTTCCAACCTTAATTGAACACTCAATGATGAAAGCCCGACTGTACAAACATGTTGCA
AGCTGCTTAAATCTGTTTAAAATATATGGTTAGAGTTTTCTAAGAAAATATAAATACTGTAAAA
AGTTCATTTTATTTTATTTTTCAGCCTTTTGTACGTAAAATGAGAAATTAAAAGTATCTTCAGG
TGGATGTCACAGTCACTATTGTTAGTTTCTGTTCCTAGCACTTTTAAATTGAAGCACTTCACAA
AATAAGAAGCAAGGACTAGGATGCAGTGTAGGTTTCTGCTTTTTTATTAGTACTGTAAACTTGC
ACACATTTCAATGTGAAACAAATCTCAAACTGAGTTCAATGTTTATTTGCTTTCAATAGTAATG
CCTTATCATTGAAAGAGGCTTAAAGAAAAAAAAATCAGCTGATACTCTTGGCATTGCTTGAAT
CCAATGTTTCCACCTAGTCTTTTTATTCAGTAATCATCAGTCTTTTCCAATGTTTGTTTACACA
GATAGATCTTATTGACCCATATGGCACTAGAACTGTATCAGATATAATATGGGATCCCAGCTTT
TTTTCCTCTCCCACAAAACCAGGTAGTGAAGTTATATTACCAGTTACAGCAAAATACTTTGTGT
TTCACAAGCAACAATAAATGTAGATTCTTTATACTGAAGCTATTGACTTGTAGTGTGTTGGTGA
AATGCATGCAGGAAAATGCTGTTACCATAAAGAACGGTAAACCACATTACAATCAAGCCAAAAG
AATAAGGTTTCGCTTTTGTTTTGTATTTAATTGTTGTCTTTGTTTCTATCTTTGAAATGCCA
TTTAAAGGTAGATTTCTATCATGTAAAAATAATCTATCTGAAAAACAAATGTAAAGAACACACA
TTAATTACTATAATTCATCTTTCAATTTTTTCATGGAATGGAAGTTAATTAAGAAGAGTGTATT
GGATAACTACTTTAATATTGGCCAAAAAGCTAGATATGGCATCAGGTAGACTAGTGGAAAGTTA
CAAAAATTAATAAAAAATTGACTAACATTTTAAGTTGTGCATCTTTTCTCCTTCCTGTCCACCT
ATTGTTCTTTTTTTCACTTTTCCATTTCAATTTCTTCCTTATGTATTCTTGATCTACTTTTCTT
TATATCCTTCTATCCTTTCCTTGCGCTCTCAGTATTTTTCATTTAGGATATTCTCCTTGTTTCT
TTTCTGTTCACCAAATGTCTTGTTTATTACAGCCTATAGATCACTTAGATTTAGATCCCTAAAA
TTTGCTGTCACTCTGTAAAGTGCACCTCGAGATAACTTCGTATAATGTATGCTATACGAAGTTA
TATGCATGCCAGTAGCAGCACCCACGTCCACCTTCTGTCTAGTAATGTCCAACACCTCCCTCAG
TCCAAACACTGCTCTGCATCCATGTGGCTCCCATTTATACCTGAAGCACTTGATGGGCCTCAA
TGTTTTACTAGAGCCCACCCCCTGCAACTCTGAGACCCTCTGGATTTGTCTGTCAGTGCCTCA
CTGGGGCGTTGGATAATTTCTTAAAAGGTCAAGTTCCCTCAGCAGCATTCTCTGAGCAGTCTGA
AGATGTGTGCTTTTCACAGTTCAAATCCATGTGGCTGTTTCACCCACCTGCCTGGCCTTGGGTT
ATCTATCAGGACCTAGCCTAGAAGCAGGTGTGTGGCACTTAACACCTAAGCTGAGTGACTAACT
GAACACTCAAGTGGATGCCATCTTTGTCACTTCTTGACTGTGACACAAGCAACTCCTGATGCCA
AAGCCCTGCCCACCCCTCTCATGCCCATATTTGGACATGGTACAGGTCCTCACTGGCCATGGTC
TGTGAGGTCCTGGTCCTCTTTGACTTCATAATTCCTAGGGGCCACTAGTATCTATAAGAGGAAG
AGGGTGCTGGCTCCCAGGCCACAGCCCACAAAATTCCACCTGCTCACAGGTTGGCTGGCTCGAC
CCAGGTGGTGTCCCTGCTCTGAGCCAGCTCCGGCCAAGCCAGCACCATGGGAACCCCAAGA
AGAAGAGGAAGGTGCGTACCGATTTAAATTCCAATTTACTGACCGTACACCAAAATTTGCCTGC
ATTACCGGTCGATGCAACGAGTGATGAGGTTCGCAAGAACCTGATGGACATGTTCAGGGATCGC
CAGGCGTTTTCTGAGCATACCTGGAAAATGCTTCTGTCCGTTTGCCGGTCGTGGGCGGCATGGT
GCAAGTTGAATAACCGGAAATGGTTTCCCGCAGAACCTGAAGATGTTCGCGATTATCTTCTATA
TCTTCAGGCGCGGTCTGGCAGTAAAAACTATCCAGCAACATTTGGGCCAGCTAAACATGCTT
CATCGTCGGTCCGGGCTGCCACGACCAAGTGACAGCAATGCTGTTTCACTGGTTATGCGGCGGA
```

FIG. 6 (cont'd)

```
TCCGAAAAGAAAACGTTGATGCCGGTGAACGTGCAAAACAGGTAAATATAAAATTTTTAAGTGT
ATAATGATGTTAAACTACTGATTCTAATTGTTTGTGTATTTTAGGCTCTAGCGTTCGAACGCAC
TGATTTCGACCAGGTTCGTTCACTCATGGAAAATAGCGATCGCTGCCAGGATATACGTAATCTG
GCATTTCTGGGGATTGCTTATAACACCCTGTTACGTATAGCCGAAATTGCCAGGATCAGGGTTA
AAGATATCTCACGTACTGACGGTGGGAGAATGTTAATCCATATTGGCAGAACGAAAACGCTGGT
TAGCACCGCAGGTGTAGAGAAGGCACTTAGCCTGGGGGTAACTAAACTGGTCGAGCGATGGATT
TCCGTCTCTGGTGTAGCTGATGATCCGAATAACTACCTGTTTTGCCGGGTCAGAAAAATGGTG
TTGCCGCCATCTGCCACCAGCCAGCTATCAACTCGCGCCCTGGAAGGGATTTTGAAGCAAC
TCATCGATTGATTTACGGCGCTAAGGATGACTCTGGTCAGAGATACCTGGCCTGGTCTGGACAC
AGTGCCCGTGTCGGAGCCGCGCGAGATATGGCCCGCGCTGGAGTTTCAATACCGGAGATCATGC
AAGCTGGTGGCTGGACCAATGTAAATATTGTCATGAACTATATCCGTAACCTGGATAGTGAAAC
AGGGGCAATGGTGCGCCTGCTGGAAGATGGCGATTAGgcggccggccgctaatcagccatacca
catttgtagaggttttacttgctttaaaaaacctcccacacctcccctgaacctgaaacataa
aatgaatgcaattgttgttgttaacttgtttattgcagcttataatggttacaaataaagcaat
agcatcacaaatttcacaaataaagcattttttcactgcattctagttgtggtttgtccaaac
tcatcaatgtatcttatcatgtcTGGATCCCCGGCTAGAGTTTAAACACTAGAACTAGTGGAT
CCCCCGGGATCATGGCCTCCGCGCCGGGTTTTGGCGCCTCCCGCGGGCGCCCCCTCCTCACGG
CGAGCGCTGCCACGTCAGACGAAGGGCGCAGCGAGCGTCCTGATCCTTCCGCCCGGACGCTCAG
GACAGCGGCCCGCTGCTCATAAGACTCGGCCTTAGAACCCAGTATCAGCAGAAGGACATTTTA
GGACGGGACTTGGGTGACTCTAGGGCACTGGTTTTCTTTCCAGAGAGCGGAACAGGCGAGGAAA
AGTAGTCCCTTCTCGGCGATTCTGCGGAGGGATCTCCGTGGGCGGTGAACGCCGATGATTATA
TAAGGACGCGCCGGGTGTGGCACAGCTAGTTCCGTCGCAGCCGGGATTTGGGTCGCGGTTCTTG
TTTGTGGATCGCTGTGATCGTCACTTGGTGAGTAGCGGGCTGCTGGGCTGGCCGGGGCTTTCGT
GGCCGCCGGGCCGCTCGGTGGGACGGAAGCGTGTGGAGAGACCGCCAAGGGCTGTAGTCTGGGT
CCGCGAGCAAGGTTGCCCTGAACTGGGGGTTGGGGGAGCGCAGCAAAATGGCGGCTGTTCCCG
AGTCTTGAATGGAAGACGCTTGTGAGGCGGGCTGTGAGGTCGTTGAAACAAGGTGGGGGGCATG
GTGGGCGGCAAGAACCCAAGGTCTTGAGGCCTTCGCTAATGCGGGAAAGCTCTTATTCGGGTGA
GATGGGCTGGGGCACCATCTGGGGACCCTGACGTGAAGTTTGTCACTGACTGGAGAACTCGGTT
TGTCGTCTGTTGCGGGGCGGCAGTTATGGCGGTGCCGTTGGGCAGTGCACCCGTACCTTTGGG
AGCGCGCGCCCTCGTCGTGTCGTGACGTCACCCGTTCTGTTGGCTTATAATGCAGGGTGGGGCC
ACCTGCCGGTAGGTGTGCGGTAGGCTTTTCTCCGTCGCAGGACGCAGGGTTCGGGCCTAGGGTA
GGCTCTCCTGAATCGACAGGCGCCCGGACCTCTGGTGAGGGGAGGGATAAGTGAGGCGTCAGTTT
CTTTGGTCGGTTTTATGTACCTATCTTCTTAAGTAGCTGAAGCTCCGGTTTTGAACTATGCGCT
CGGGGTTGGCGAGTGTGTTTTGTGAAGTTTTTAGGCACCTTTTGAAATGTAATCATTTGGGTC
AATATGTAATTTTCAGTGTTAGACTAGTAAATTGTCCGCTAAATTCTGGCCGTTTTTGGCTTTT
TTGTTAGACGTGTTGACAATTAATCATCGGCATAGTATATCGGCATAGTATAATACGACAAGGT
GAGGAACTAAACCATGGGATCGGCCATTGAACAAGATGGATTGCACGCAGGTTCTCCGGCCGCT
TGGGTGGAGAGGCTATTCGGCTATGACTGGGCACAACAGACAATCGGCTGCTCTGATGCCGCCG
TGTTCCGGCTGTCAGCGCAGGGGCGCCCGGTTCTTTTTGTCAAGACCGACCTGTCCGGTGCCCT
GAATGAACTGCAGGACGAGGCAGCGCGGCTATCGTGGCTGGCCACGACGGGCGTTCCTTGCGCA
GCTGTGCTCGACGTTGTCACTGAAGCGGGAAGGGACTGGCTGCTATTGGGCGAAGTGCCGGGGC
AGGATCTCCTGTCATCTCACCTTGCTCCTGCCGAGAAAGTATCCATCATGGCTGATGCAATGCG
GCGGCTGCATACGCTTGATCCGGCTACCTGCCCATTCGACCACCAAGCGAAACATCGCATCGAG
CGAGCACGTACTCGGATGGAAGCCGGTCTTGTCGATCAGGATGATCTGGACGAAGAGCATCAGG
GGCTCGCGCCAGCCGAACTGTTCGCCAGGCTCAAGGCGCGCATGCCCGACGGCGATGATCTCGT
```

*CGTGACCCATGGCGATGCCTGCTTGCCGAATATCATGGTGGAAAATGGCCGCTTTTCTGGATTC*
*ATCGACTGTGGCCGGCTGGGTGTGGCGGACCGCTATCAGGACATAGCGTTGGCTACCCGTGATA*
*TTGCTGAAGAGCTTGGCGGCGAATGGGCTGACCGCTTCCTCGTGCTTTACGGTATCGCCGCTCC*
*CGATTCGCAGCGCATCGCCTTCTATCGCCTTCTTGACGAGTTCTTCTGAGGGGATCCGCTGTAA*
*GTCTGCAGAAATTGATGATCTATTAAACAATAAAGATGTCCACTAAAATGGAAGTTTTTCCTGT*
*CATACTTTGTTAAGAAGGGTGAGAACAGAGTACCTACATTTTGAATGGAAGGATTGGAGCTACG*
*GGGGTGGGGTGGGGTGGGATTAGATAAATGCCTGCTCTTTACTGAAGGCTCTTTACTATTGCT*
*TTATGATAATGTTTCATAGTTGGATATCATAATTTAAACAAGCAAAACCAAATTAAGGGCCAGC*
*TCATTCCTCCCACTCATGATCTATAGATCTATAGATCTCTCGTGGGATCATTGTTTTCTCTTG*
*ATTCCCACTTTGTGGTTCTAAGTACTGTGGTTTCCAAATGTGTCAGTTTCATAGCCTGAAGAAC*
*GAGATCAGCAGCCTCTGTTCCACATACACTTCATTCTCAGTATTGTTTTGCCAAGTTCTAATTC*
*CATCAGACCTCGACCTGCAGCCCCTAGATAACTTCGTATAATGTATGCTATACGAAGTTATGCT*
*AGTAACTATAACGGTCCTAAGGTAGCGAGCTAGC*agcttcggttttgatacactgtttacagcc
tgcgaaggtgactcactcgtgttaataagactcttttacgg

RODENTS HAVING GENETICALLY MODIFIED SODIUM CHANNELS AND METHODS OF USE THEREOF

CROSS REFERENCE TO RELATED APPLICATIONS

This application claims the benefit of priority from U.S. Provisional Application No. 62/808,957, filed Feb. 22, 2019, the entire contents of which are incorporated herein by reference.

INCORPORATION BY REFERENCE OF SEQUENCE LISTING

The sequence listing in the ASCII text file, named as 36328_0403US01_SequenceListing.txt of 781 KB, created on Feb. 20, 2020, and submitted to the United States Patent and Trademark Office via EFS-Web, is incorporated herein by reference in its entirety.

BACKGROUND

The voltage-gated channel alpha subunit 9 (Scn9a) is a gene that encodes NaV1.7 protein. NaV1.7 is a member of the family of voltage-gated sodium channels and is important for electrical signaling by most excitable cells. NaV1.7 is present in pain-sensing nerves, the nociceptors, and assists in transmitting the sensation of pain. Gain of function mutations in the human SCN9A gene have been associated with pain syndromes, while loss of function mutations cause d insensitivity to pain.

SUMMARY OF THE DISCLOSURE

Disclosed herein are embodiments of non-human animals genetically modified to express an exogenous NaV1 protein, e.g., NaV1.2 protein. In some embodiments, a non-human animal comprises an exogenous Scn nucleotide sequence (e.g., a Scn2a gene sequence, e.g., a human SCN2A gene sequence). Also disclosed herein are embodiments of methods and compositions useful for making such genetically modified non-human animals, and embodiments of methods of using such genetically modified non-human animals for generating antibodies that bind a NaV1.7 protein (e.g., a human NaV1.7 protein) or a functional portion thereof. Scn9a is the name of the gene that encodes a NaV1.7 protein. Scn2a is the name of the gene that encodes a NaV1.2 protein. In some embodiments, a non-human animal is a rodent (e.g., a mouse or a rat).

In one aspect of the embodiments, disclosed herein is a genetically modified rodent (e.g., a mouse or a rat) whose genome (e.g., germline genome) comprises a nucleic acid molecule encoding a NaV1.2 protein. In some embodiments, a nucleic acid molecule encoding a NaV1.2 protein is at an endogenous rodent (e.g., rat or mouse) Scn9a locus. In some embodiments, a nucleic acid molecule encoding a NaV1.2 protein is at a locus that includes genes expressed in nociceptors. In some embodiments, a nucleic acid molecule encoding a NaV1.2 protein is at a transcriptionally active or permissive locus, e.g., a ROSA26 locus (Zambrowicz et al., 1997, PNAS USA 94:3789-3794, which is incorporated herein by reference), a BT-5 locus (Michael et al, 1999, Mech. Dev, 85:35-47, which is incorporated herein by reference), or an Oct41 ocus (Wallace et al., 2000, Nucleic Acids Res. 28:1455-1464, which is incorporated herein by reference). In some embodiments, a NaV1.2 protein is expressed from a nucleic acid molecule encoding a NaV1.2 protein in the genome of a genetically modified rodent e.g., rat or mouse).

In some embodiments, a nucleic acid molecule encodes a NaV1.2 protein of a human, chimpanzee, rhesus monkey, sunda flying lemur, rabbit, horse, Arabian camel, killer whale, cattle, sheep, rat, mouse, dog, chicken, green sea turtle, or king cobra. In some embodiments, a nucleic acid molecule encodes a human NaV1.2 protein. In some embodiments, a nucleic acid molecule encodes a NaV1.2 protein comprising an amino acid sequence having at least 95% identity with SEQ ID NO: 4. In some embodiments, a nucleic acid molecule encodes a NaV1.2 protein comprising an amino acid sequence having at least 96% identity with SEQ ID NO: 4. In some embodiments, a nucleic acid molecule encodes a NaV1.2 protein comprising an amino acid sequence having at least 97% identity with SEQ ID NO: 4. In some embodiments, a nucleic acid molecule encodes a NaV1.2 protein comprising an amino acid sequence having at least 98% identity with SEQ ID NO: 4. In some embodiments, a nucleic acid molecule encodes a NaV1.2 protein comprising an amino acid sequence having at least 99% identity with SEQ ID NO: 4. In some embodiments, a nucleic acid molecule encodes a NaV1.2 protein comprising an amino acid sequence having greater than 99% identity with SEQ ID NO: 4. In some embodiments, a nucleic acid molecule encodes a NaV1.2 protein comprising an amino acid sequence identical to SEQ ID NO: 4.

In some embodiments, a nucleic acid molecule encoding a NaV1.2 protein is operably linked to a rodent (e.g., rat or mouse) Seri promoter. In some embodiments, a nucleic acid molecule encoding a NaV1.2 protein is operably linked to a rodent (e.g., rat or mouse) Scn9a promoter. In some embodiments, a nucleic acid molecule encoding a NaV1.2 protein is operably linked to an endogenous rodent (e.g., rat or mouse) Scn9a promoter at an endogenous rodent (e.g., rat or mouse) Scn9a locus.

In some embodiments, a nucleic acid molecule encoding the NaV1.2 protein is DNA (e.g., genomic DNA or cDNA). In some embodiments, a nucleic acid molecule encoding the NaV1.2 protein comprises a nucleotide sequence of contiguous nucleotides from the ATG start codon to the stop codon of a Scn2a gene. In some embodiments, a nucleic acid molecule encoding the NaV1.2 protein includes a DNA sequence encoding a 5' UTR of an endogenous rodent (e.g., rat or mouse) Scn9a gene. In some embodiments, a nucleic acid molecule encoding the NaV1.2 protein includes a DNA sequence encoding a 5' UTR of a Scn2a gene. In some embodiments, a nucleic acid molecule encoding the NaV1.2 protein includes a DNA sequence encoding a 3' UTR of an endogenous rodent (e.g., rat or mouse) Scn9a gene. In some embodiments, a nucleic acid molecule encoding the NaV1.2 protein includes a DNA sequence encoding a 3' UTR of s Scn2a gene.

In some embodiments, a nucleic acid molecule encoding the NaV1.2 protein is in place of a genomic fragment of the endogenous rodent (e.g., rat or mouse) Scn9a gene at the endogenous rodent (e.g., rat or mouse) Scn9a locus. In some embodiments, a genomic fragment comprises a nucleotide sequence encoding the endogenous rodent (e.g., rat or mouse) NaV1.7 protein. In some embodiments, a coding region (e.g., from the ATG codon to the stop codon) of an endogenous rodent (e.g., rat or mouse) Scn9a gene has been replaced.

In some embodiments, a nucleic acid molecule encoding a NaV1.2 protein is a genomic fragment of a Scn2a gene. In some embodiments, a nucleic acid molecule encoding a NaV1.2 protein is a cDNA. In some embodiments, a nucleic acid molecule encoding a NaV1.2 protein is a recombinant DNA. In some embodiments, a nucleic acid molecule encoding a NaV1.2 protein can comprise a nucleotide sequence modified from a wild-type sequence. In some embodiments, a nucleic acid molecule encoding a NaV1.2 protein can comprise a nucleotide sequence modified from a wild-type sequence, e.g., codon optimized from a wild-type sequence. In some embodiments, a nucleic acid molecule encoding a NaV1.2 protein can comprise a nucleotide sequence modified from a wild-type sequence, e.g., modified to remove T-cell epitopes from a wild-type sequence.

In some embodiments, a genetically modified rodent (e.g., rat or mouse) is heterozygous with respect to a nucleic acid molecule encoding a NaV1.2 protein. In some embodiments, a genetically modified rodent (e.g., rat or mouse) is homozygous with respect to a nucleic acid molecule encoding a NaV1.2 protein.

In some embodiments, a genetically modified rodent (e.g., rat or mouse) is incapable of expressing a rodent (e.g., rat or mouse) NaV1.7 protein as a result of an inactivation (such as, but not limited to, a deletion in full or in part, or an inversion in full or in part) or a replacement (in full or in part) of the endogenous rodent (e.g., rat or mouse) Scn9a gene.

In some embodiments, a genetically modified rodent (e.g., rat or mouse) produces antibodies against a NaV1.7 protein (e.g., a human NaV1.7 protein) when immunized with a NaV1.7 immunogen (e.g., a human NaV1.7 immunogen). In some embodiments, a NaV1.7 immunogen can be a protein immunogen, a DNA immunogen, or a combination thereof.

In some embodiments, a genetically modified rodent (e.g., rat or mouse) comprises in its genome (e.g., its germline genome) a humanized immunoglobulin heavy chain locus, a humanized immunoglobulin light chain locus, or a combination thereof as described herein.

In some embodiments, a genetically modified rodent (e.g., rat or mouse) comprises in its genome (e.g., its germline genome) a humanized immunoglobulin heavy chain locus comprising one or more human $V_H$ gene segments, one or more human $D_H$ gene segments, and one or more human $J_H$ gene segments that are upstream of (e.g., operably linked to) one or more rodent (e.g., rat or mouse) immunoglobulin heavy chain constant region genes (e.g., one or more endogenous rodent (e.g., rat or mouse) mmunoglobulin heavy chain constant region genes). Such a humanized immunoglobulin heavy chain locus is referred to herein as a "humanized HoH locus." In some embodiments, a genetically modified rodent (e.g., rat or mouse) is homozygous at a humanized HoH locus. In some embodiments, a genetically modified rodent (e.g., rat or mouse) is heterozygous at a humanized HoH locus.

In some embodiments, a genetically modified rodent (e.g., rat or mouse), which comprises a humanized HoH locus, produces an antibody comprising, inter alia, heavy chains, where each heavy chain comprises a human heavy chain variable domain operably linked to a rodent (e.g., rat or mouse) heavy chain constant domain, e.g., in response to antigenic stimulation.

In some embodiments, a genetically modified rodent (e.g., rat or mouse) comprises in its genome (e.g., its germline genome) a humanized immunoglobulin heavy chain locus comprising one or more human $V_L$ gene segments and one or more human $J_L$ gene segments that are upstream of (e.g., operably linked to) one or more rodent (e.g., rat or mouse) immunoglobulin heavy chain constant region genes (e.g., one or more endogenous rodent (e.g., rat or mouse) immu- noglobulin heavy chain constant region genes). Such a humanized immunoglobulin heavy chain locus is referred to herein as a "humanized LoH locus." In some embodiments, a genetically modified rodent (e.g., rat or mouse) is homozygous at a humanized LoH locus. In some embodiments, a genetically modified rodent (e.g., rat or mouse) is heterozygous at a humanized LoH locus.

In some embodiments, a genetically modified rodent (e.g., rat or mouse), which comprises a humanized LoH locus, produces an antibody comprising, inter alia, immunoglobulin chains, where each immunoglobulin chain comprises a human light chain variable domain operably linked to a rodent (e.g., rat or mouse) heavy chain constant domain, e.g., in response to antigenic stimulation.

In some embodiments, a genetically modified rodent (e.g., rat or mouse) comprises in its genome (e.g., its germline genome) a humanized immunoglobulin light chain locus comprising one or more human $V_L$ gene segments and one or more human $J_L$ gene segments that are upstream of (e.g., operably linked to) one or more immunoglobulin light chain constant region genes. In some embodiments, one or more human $V_L$ gene segments and one or more human $J_L$ gene segments are one or more human Vκ gene segments and one or more human Jκ gene segments. In some embodiments, one or more human $V_L$ gene segments and one or more human $J_L$ gene segments are one or more human Vλ gene segments and one or more human Jλ gene segments. In some embodiments, one or more immunoglobulin light chain constant region genes is or comprises a Cκ. In some embodiments, one or more immunoglobulin light chain constant region genes is or comprises a Cλ.

In some embodiments, a genetically modified rodent (e.g., rat or mouse) comprises in its genome (e.g., its germline genome) a humanized immunoglobulin light chain locus comprising one or more human Vκ gene segments and one or more human Jκ gene segments that are upstream of (e.g., operably linked to) a Cκ gene. Such a humanized immunoglobulin heavy chain locus is referred to herein as a "humanized KoK locus." In some embodiments, an immunoglobulin κ light chain constant region gene of a humanized KoK locus is a rodent (e.g., rat or mouse) Cκ gene. In some embodiments, an immunoglobulin κ light chain constant region gene of a humanized KoK locus is an endogenous rodent (e.g., rat or mouse) Cκ gene. In some embodiments, an immunoglobulin κ light chain constant region gene of a humanized KoK locus is an endogenous rodent (e.g., rat or mouse) Cκ gene at an endogenous immunoglobulin κ light chain locus. In some embodiments, a genetically modified rodent (e.g., rat or mouse) is homozygous at a humanized KoK locus. In some embodiments, a genetically modified rodent (e.g., rat or mouse) is heterozygous at a humanized KoK locus.

In some embodiments, a genetically modified rodent (e.g., rat or mouse), which comprises a humanized KoK locus, produces an antibody comprising, inter alia, κ light chains, where each κ light chain comprises a human κ light chain variable domain operably linked to a rodent (e.g., rat or mouse) κ light chain constant domain, e.g., in response to antigenic stimulation.

In some embodiments, a genetically modified rodent (e.g., rat or mouse) comprises in its genome (e.g., its germline genome) a humanized immunoglobulin light chain locus comprising one or more human Vλ gene segments upstream of (e.g., operably linked to) one or more human Jλ gene segments and one or more Cλ genes. Such a humanized immunoglobulin light chain locus is referred to herein as a "humanized LoL locus." In some embodiments, the one or more human Jλ gene segments and one or more Cλ genes of a humanized LoL locus are present in Jλ-Cλ clusters. In some embodiments, one or more Cλ genes of a humanized LoL locus comprise one or more human Cλ genes. In some embodiments, one or more Cλ genes of a humanized LoL locus comprise one or more mouse Cλ genes. In some embodiments, one or more Cλ genes of a humanized LoL locus comprise one or more human Cλ genes and one or more mouse Cλ genes. In some embodiments, one or more mouse Cλ genes of a humanized LoL locus comprise a mouse Cλ1 gene. In some embodiments, a genetically modified rodent (e.g., rat or mouse) is homozygous at a humanized LoL locus. In some embodiments, a genetically modified rodent (e.g., rat or mouse) is heterozygous at a humanized LoL locus.

In some embodiments, a genetically modified rodent (e.g., rat or mouse), which comprises a humanized LoL locus, produces an antibody comprising, inter alia, λ light chains, where each λ light chain comprises a human λ light chain variable domain operably linked to a rodent (e.g., rat or mouse) λ light chain constant domain, e.g., in response to antigenic stimulation. In some embodiments, a genetically modified rodent (e.g., rat or mouse), which comprises a humanized LoL, locus, produces an antibody comprising, inter alia, λ light chains, where each λ light chain comprises a human λ light chain variable domain operably linked to a human λ light chain constant domain, e.g., in response to antigenic stimulation.

In some embodiments, a genetically modified rodent (e.g., rat or mouse) comprises in its genome (e.g., its germline genome) a humanized immunoglobulin light chain locus comprising one or more human Vλ gene segments and one or more human Jλ gene segments upstream of (e.g., operably linked to) a Cκ gene. Such a humanized immunoglobulin light chain locus is referred to herein as a "humanized LoK locus." In some embodiments, a Cκ gene of a humanized LoK locus is a rodent (e.g., rat or mouse) Cκ gene. In some embodiments, a Cκ gene of a humanized LoK locus is an endogenous rodent (e.g., rat or mouse) Cκ gene. In some embodiments, a Cκ gene of a humanized LoK locus is an endogenous rodent (e.g., rat or mouse) Cκ gene at an endogenous immunoglobulin κ light chain locus. In some embodiments, a genetically modified rodent (e.g., rat or mouse) is homozygous at a humanized LoK locus. In some embodiments, a genetically modified rodent (e.g., rat or mouse) is heterozygous at a humanized LoK locus.

In some embodiments, a genetically modified rodent (e.g., rat or mouse), which comprises a humanized LoK locus, produces an antibody comprising, inter alia, light chains, where each light chain comprises a human λ light chain variable domain operably linked to a rodent (e.g., rat or mouse) κ light chain constant domain, e.g., in response to antigenic stimulation.

In some embodiments, a genetically modified rodent (e.g., rat or mouse) comprises in its genome (e.g., its germline genome) a humanized immunoglobulin κ light chain locus comprising one or more human Vλ gene segments and one or more human Jλ gene segments upstream of (e.g., operably linked to) a Cλ gene. Such a humanized immunoglobulin light chain locus is referred to herein as a "humanized LiK locus." In some embodiments, a Cλ gene of a humanized locus is a rodent (e.g., rat or mouse) Cλ gene. In some embodiments, a Cλ gene of a humanized LiK locus is a mouse Cλ1 gene. In some embodiments, a genetically modified rodent (e.g., rat or mouse) is homozygous at a humanized LiK locus. In some embodiments, a genetically modified rodent (e.g., rat or mouse) is heterozygous at a humanized LiK locus.

In some embodiments, a genetically modified rodent (e.g., rat or mouse), which comprises a humanized LiK locus, produces an antibody comprising, inter alia, λ light chains, where each λ light chain comprises a human λ light chain variable domain operably linked to a rodent (e.g., rat or mouse) λ light chain constant domain, e.g., in response to antigenic stimulation.

In some embodiments, a genetically modified rodent (e.g., rat or mouse) comprises in its genome (e.g., its germline genome) a humanized immunoglobulin κ light chain locus comprising one or more human Vλ gene segments upstream of (e.g., operably linked to) one or more human Jλ gene segments and one or more human Cλ genes. In some embodiments, the one or more human Jλ gene segments and one or more Cλ genes of such a humanized immunoglobulin κ light chain locus are present in Jλ-Cλ clusters. In some embodiments, a genetically modified rodent (e.g., rat or mouse) is homozygous for such a humanized immunoglobulin κ light chain locus. In some embodiments, a genetically modified rodent (e.g., rat or mouse) is heterozygous for such a humanized immunoglobulin κ light chain locus. In some embodiments, a genetically modified rodent (e.g., rat or mouse), which comprises such a humanized immunoglobulin κ light chain locus, produces an antibody comprising, inter alia, λ light chains, where each λ light chain comprises a human λ light chain variable domain operably linked to a human λ light chain constant domain, e.g., in response to antigenic stimulation.

In some embodiments, a genetically modified rodent (e.g., rat or mouse) comprises in its genome (e.g., its germline genome) a humanized HoH locus and a humanized KoK locus. In some embodiments, a genetically modified rodent (e.g., rat or mouse) comprises in its genome (e.g., its germline genome) a humanized HoH locus and a humanized LoL locus. In some embodiments, a genetically modified rodent (e.g., rat or mouse) comprises in its genome (e.g., its germline genome) a humanized HoH locus, a humanized KoK locus, and a humanized LoL locus. In some embodiments, a genetically modified rodent (e.g., rat or mouse) is homozygous at a humanized HoH locus, a humanized KoK locus, a humanized LoL locus, or a combination thereof.

In some embodiments, a genetically modified rodent (e.g., rat or mouse) comprises in its genome (e.g., its germline genome) a humanized HoH locus, a humanized KoK locus, and a humanized LoK locus. In some embodiments, a genetically modified rodent (e.g., rat or mouse) comprises in its genome (e.g., its germline genome) a humanized HoH locus, a humanized KoK locus, and a humanized LiK locus.

In some embodiments, a genetically modified rodent rat or mouse) comprises in its genome (e.g., its germline genome) a humanized HoH locus and a humanized LoK locus. In some embodiments, a genetically modified rodent (e.g., rat or mouse) is homozygous at a humanized HoH locus, a humanized LoK locus, or a combination thereof.

In some embodiments, a genetically modified rodent (e.g., rat or mouse) comprises in its genome (e.g., its germline genome) a humanized HoH locus and a humanized LiK locus. In some embodiments, a genetically modified rodent (e.g., rat or mouse) is homozygous at a humanized HoH locus, a humanized LiK locus, or a combination thereof.

In some embodiments, a genetically modified rodent (e.g., rat or mouse) comprises in its genome (e.g., its germline genome) a humanized LoH locus and a humanized KoK locus. In some embodiments, a genetically modified rodent (e.g., rat or mouse) comprises in its genome (e.g., its germline genome) a humanized LoH locus and a humanized LoL locus. In some embodiments, a genetically modified rodent (e.g., rat or mouse) comprises in its genome (e.g., its germline genome) a humanized LoH locus, a humanized KoK locus, and a humanized LoL locus. In some embodiments, a genetically modified rodent (e.g., rat or mouse) is homozygous at a humanized LoH locus, a humanized KoK locus, a humanized LoL locus, or a combination thereof.

In some embodiments, a genetically modified rodent (e.g., rat or mouse) comprises in its genome (e.g., its germline genome) a humanized LoH locus, a humanized KoK locus, and a humanized LoK locus. In some embodiments, a genetically modified rodent (e.g., rat or mouse) comprises in its genome (e.g., its germline genome) a humanized LoH locus, a humanized KoK locus, and a humanized LiK locus.

In some embodiments, a genetically modified rodent (e.g., rat or mouse) comprises in its genome (e.g., its germline genome) a humanized LoH locus and a humanized LoK locus. In some embodiments, a genetically modified rodent (e.g., rat or mouse) is homozygous at a humanized LoH locus, a humanized LoK locus, or a combination thereof.

In some embodiments, a genetically modified rodent (e.g., rat or mouse) comprises in its genome (e.g., its germline genome) a humanized LoH locus and a humanized LiK locus. In some embodiments, a genetically modified rodent (e.g., rat or mouse) is homozygous at a humanized LoH locus, a humanized LiK locus, or a combination thereof.

In some embodiments, a genetically modified rodent (e.g., rat or mouse) as provided herein has a genome (e.g., a germline genome) comprising a humanized immunoglobulin heavy chain (e.g., HoH or LoH) locus lacking a functional endogenous rodent Adam6 gene. In some embodiments, a genetically modified rodent (e.g., rat or mouse) as provided herein has a genome (e.g., a germline genome) comprising one or more nucleotide sequences encoding one or more rodent ADAM6 polypeptides, functional orthologs, functional homologs, or functional fragments thereof. In some embodiments, a genetically modified rodent (e.g., rat or mouse) as provided expresses one or more rodent (e.g., rat or mouse) ADAM6 polypeptides, functional orthologs, functional homologs, or functional fragments thereof. In some embodiments, a genetically modified rodent (e.g., rat or mouse) as provided has a genome (e.g., a germline genome) comprising one or more nucleotide sequences encoding one or more rodent (e.g., rat or mouse) ADAM6 polypeptides, functional orthologs, functional homologs, or functional fragments thereof that are included on the same chromosome as a humanized immunoglobulin heavy chain (e.g., HoH or LoH) locus. In some embodiments, a genetically modified rodent (e.g., rat or mouse) as provided has a genome (e.g., a germline genome) comprising a humanized immunoglobulin heavy chain (e.g., HoH or LoH) locus comprising one or more nucleotide sequences encoding one or more rodent ADAM6 polypeptides, functional orthologs, functional homologs, or functional fragments thereof. In some embodiments, a genetically modified rodent (e.g., rat or mouse) as provided has a genome (e.g., a germline genome) comprising one or more nucleotide sequences encoding one or more rodent (e.g., rat or mouse) ADAM6 polypeptides, functional orthologs, functional homologs, or functional fragments thereof in place of a human Adam6 pseudogene. In some embodiments, a genetically modified rodent (e.g., rat or mouse) as provided has a genome (e.g., germline genome) comprising one or more nucleotide sequences encoding one or more rodent (e.g., rat or mouse) ADAM6 polypeptides, functional orthologs, functional homologs, or functional fragments thereof that replace a human Adam6 pseudogene.

In some embodiments, a genetically modified rodent as provided has a genome (e.g., a germline genome) comprising one or more human $V_H$ gene segments comprising a first and a second human $V_H$ gene segment, and one or more nucleotide sequences encoding one or more rodent (e.g., rat or mouse) ADAM6 polypeptides, functional orthologs, functional homologs, or functional fragments thereof between the first human $V_H$ gene segment and the second human $V_H$ gene segment. In some embodiments, a first human $V_H$ gene segment is $V_H1$-2 and a second human $V_H$ gene segment is $V_H6$-1.

In some embodiments, one or more nucleotide sequences encoding one or more rodent (e.g., a rat or mouse) ADAM6 polypeptides, functional orthologs, functional homologs, or functional fragments thereof are between a human $V_H$ gene segment and a human $D_H$ gene segment.

In some embodiments, one or more nucleotide sequences encoding one or more rodent ADAM6 polypeptides restore or enhance fertility in a male rodent.

In some embodiments, a genetically modified rodent (e.g., rat or mouse) comprises an exogenous terminal deoxynucleotidyl transferase (TdT) gene. In some embodiments, a rodent (e.g., rat or mouse) that comprises an exogenous terminal deoxynucleotidyl transferase (TdT) gene can have increased antigen receptor diversity when compared to a rodent without an exogenous TdT gene.

In some embodiments, a rodent as described herein has a genome comprising an exogenous terminal deoxynucleotidyltransferase (TdT) gene operably linked to a transcriptional control element.

In some embodiments, a transcriptional control element includes a RAG1 transcriptional control element, a RAG2 transcriptional control element, an immunoglobulin heavy chain transcriptional control element, an immunoglobulin κ light chain transcriptional control element, an immunoglobulin λ light chain transcriptional control element, or any combination thereof.

In some embodiments, an exogenous TdT is located at an immunoglobulin κ light chain locus, an immunoglobulin λ light chain locus, an immunoglobulin heavy chain locus, a RAG1 locus, or a RAG2 locus.

In some embodiments, a TdT is a human TdT. In some embodiments, a TdT is a short isoform of TdT (TdTS).

In another aspect of the embodiments, disclosed herein are methods of making a genetically modified rodent (e.g., a mouse or a rat), the methods comprising modifying a rodent genome (e.g., germline genome) such that the modified rodent genome comprises a nucleic acid molecule encoding a NaV1.2 protein. In some embodiments, a nucleic acid molecule encoding a NaV1.2 protein is at an endogenous rodent (e.g., rat or mouse) Scn9a locus. In some embodiments, a nucleic acid molecule encoding a NaV1.2 protein is at a locus that includes genes expressed in nociceptors. In some embodiments, a nucleic acid molecule encoding a NaV1.2 protein is at a transcriptionally active or permissive locus, e.g., a ROSA26 locus (Zambrowicz et al., 1997, PNAS USA 94:3789-3794, which is incorporated herein by reference), a BT-5 locus (Michael et al., 1999, Mech., Dev. 85:35-47, which is incorporated herein by reference), or an Oct41 ocus (Wallace et al., 2000, Nucleic Acids Res. 28:1455-1464, which is incorporated herein by reference). In some embodiments, a NaV1.2 protein is expressed from a nucleic acid molecule encoding a NaV1.2 protein in the genome of a genetically modified rodent (e.g., rat or mouse), and making a rodent comprising the modified genome. In some embodiments, the rodent does not express endogenous NaV1.7.

In some embodiments of the methods, a rodent genome is modified by a process comprising: (i) introducing the nucleic acid molecule encoding a NaV1.2 protein into a rodent embryonic stem (ES) cell such that the nucleic acid molecule integrates into an endogenous rodent Scn9a locus; (ii) obtaining a rodent ES cell comprising a modified genome wherein the nucleic acid molecule has integrated into the endogenous rodent Scn9a locus; and (iii) making a rodent from the obtained rodent ES cell comprising the modified genome.

In some embodiments of the methods, a nucleic acid molecule encodes a NaV1.2 protein of a human, chimpanzee, rhesus monkey, sunda flying lemur, rabbit, horse, Arabian camel, killer whale, cattle, sheep, rat, mouse, dog, chicken, green sea turtle, or king cobra. In some embodiments, a nucleic acid molecule encodes a human NaV1.2 protein. In some embodiments, a nucleic acid molecule encodes a NaV1.2 protein comprising an amino acid sequence having at least 95% identity with SEQ ID NO: 4. In some embodiments, a nucleic acid molecule encodes a NaV1.2 protein comprising an amino acid sequence having at least 96% identity with SEQ ID NO: 4. In some embodiments, a nucleic acid molecule encodes a NaV1.2 protein comprising an amino acid sequence having at least 97% identity with SEQ ID NO: 4. In some embodiments, a nucleic acid molecule encodes a NaV1.2 protein comprising an amino acid sequence having at least 98% identity with SEQ ID NO: 4. In some embodiments, a nucleic acid molecule encodes a NaV1.2 protein comprising an amino acid sequence having at least 99% identity with SEQ ID NO: 4. In some embodiments, a nucleic acid molecule encodes a NaV1.2 protein comprising an amino acid sequence having greater than 99% identity with SEQ ID NO: 4. In some embodiments, a nucleic acid molecule encodes a NaV1.2 protein comprising an amino acid sequence identical to SEQ ID NO: 4.

In some embodiments of the methods, a nucleic acid molecule encoding a Nav1.2 protein is operably linked to a rodent (e.g., rat or mouse) Scn promoter. In some embodiments of the method, a nucleic acid molecule encoding a NaV1.2 protein is operably linked to a rodent (e.g., rat or mouse) Scn9a promoter. In some embodiments, a nucleic acid molecule encoding a NaV1.2 protein is operably linked to an endogenous rodent (e.g., rat or mouse) Scn9a promoter at an endogenous rodent (e.g., rat or mouse) Scn9a locus.

In some embodiments of the methods, a nucleic acid molecule encoding the NaV1.2 protein is DNA (e.g., genomic DNA or cDNA). In some embodiments, a nucleic acid molecule encoding the NaV1.2 protein comprises a nucleotide sequence of contiguous nucleotides from the ATG start codon to the stop codon of a Scn2a gene. In some embodiments, a nucleic acid molecule encoding the NaV1.2 protein includes a DNA sequence encoding a 5' UTR of an endogenous rodent (e.g., rat or mouse) Scn9a gene. In some embodiments, the nucleotide sequence is operably linked to the 5' UTR of the Scn2a gene. In some embodiments, a nucleic acid molecule encoding the NaV1.2 protein includes a DNA sequence encoding a 3' UTR of an endogenous rodent (e.g., rat or mouse) Scn9a gene. In some embodiments, a nucleic acid molecule encoding the NaV1.2 protein includes a DNA sequence encoding a 3' UTR of a Scn2a gene.

In some embodiments of the methods, a nucleic acid molecule encoding the NaV1.2 protein is in place of a genomic fragment of the endogenous rodent (e.g., rat or mouse) Scn9a gene at the endogenous rodent (e.g., rat or mouse) Scn9a locus. In some embodiments, a genomic fragment comprises a nucleotide sequence encoding the endogenous rodent (e.g., rat or mouse) NaV1.7 protein. In some embodiments, a coding region (e.g., from the ATG codon to the stop codon) of an endogenous rodent (e.g., rat or mouse) Scn9a gene has been replaced.

In some embodiments of the methods, a nucleic acid molecule encoding a NaV1.2 protein is a genomic fragment of a Scn2a gene. In some embodiments, a nucleic acid molecule encoding a NaV1.2 protein is a cDNA. In some embodiments, a nucleic acid molecule encoding a NaV1.2 protein is a recombinant DNA. In some embodiments, a nucleic acid molecule encoding a NaV1.2 protein can comprise a nucleotide sequence modified from a wild-type sequence. In some embodiments, a nucleic acid molecule encoding a NaV1.2 protein can comprise a nucleotide sequence modified from a wild-type sequence, e.g., codon optimized from a wild-type sequence. In some embodiments, a nucleic acid molecule encoding a NaV1.2 protein can comprise a nucleotide sequence modified from a wild-type sequence, e.g., modified from a wild-type sequence to remove T-cell epitopes.

In some embodiments of the methods, a genetically modified rodent (e.g., rat or mouse) is heterozygous with respect to a nucleic acid molecule encoding a NaV1.2 protein. In some embodiments, a genetically modified rodent (e.g., rat or mouse) is homozygous with respect to a nucleic acid molecule encoding a NaV1.2 protein.

In some embodiments of the methods, a genetically modified rodent (e.g., rat or mouse) is incapable of expressing a rodent (e.g., rat or mouse) NaV1.7 protein as a result of an inactivation (such as, but not limited to, a deletion in full or in part, or an inversion in full or in part) or a replacement (in full or in part) of the endogenous rodent (e.g., rat or mouse) Scn9a gene.

In some embodiments of the methods, a genetically modified rodent (e.g., rat or mouse) produces antibodies against a NaV1.7 protein (e.g., a human NaV1.7 protein) when immunized with a NaV1.7 immunogen (e.g., a human NaV1.7 immunogen). In some embodiments, a NaV1.7 immunogen can be a protein immunogen, a DNA immunogen, or a combination thereof.

In some embodiments of the method, a genetically modified rodent (e.g., rat or mouse) comprises in its genome (e.g., its germline genome) a humanized immunoglobulin heavy chain locus, a humanized immunoglobulin light chain locus, or a combination thereof, as described herein.

In some embodiments of the methods, a genetically modified rodent (e.g., rat or mouse) comprises in its genome (e.g., its germline genome) a humanized immunoglobulin heavy chain locus comprising one or more human $V_H$ gene segments, one or more human $D_H$ gene segments, and one or more human $J_H$ gene segments that are upstream of (e.g., operably linked to) one or more rodent (e.g., rat or mouse) immunoglobulin heavy chain constant region genes es. one or more endogenous rodent (e.g., rat or mouse) immunoglobulin heavy chain constant region genes). Such a humanized immunoglobulin heavy chain locus is referred to herein as a "humanized HoH locus," In some embodiments, a genetically modified rodent (e.g., rat or mouse) is homozygous at a humanized HoH locus. In some embodiments, a genetically modified rodent (e.g., rat or mouse) is heterozygous at a humanized HoH locus.

In some embodiments of the methods, a genetically modified rodent (e.g., rat or mouse), which comprises a humanized HoH locus, produces an antibody comprising, inter alia, heavy chains, where each heavy chain comprises a human heavy chain variable domain operably linked to a rodent (e.g., rat or mouse) heavy chain constant domain, e.g., in response to antigenic stimulation.

In some embodiments of the methods, a genetically modified rodent (e.g., rat or mouse) comprises in its genome (e.g., its germline genome) a humanized immunoglobulin heavy chain locus comprising one or more human $V_L$ gene segments and one or more human $J_L$ gene segments that are upstream of (e.g., operably linked to) one or more rodent (e.g., rat or mouse) immunoglobulin heavy chain constant region genes (e.g., one or more endogenous rodent (e.g., rat or mouse) immunoglobulin heavy chain constant region genes). Such a humanized immunoglobulin heavy chain locus is referred to herein as a "humanized LoH locus." In some embodiments, a genetically modified rodent (e.g., rat or mouse) is homozygous at a humanized LoH locus. In some embodiments, a genetically modified rodent (e.g., rat or mouse) is heterozygous at a humanized LoH locus.

In some embodiments of the methods, a genetically modified rodent (e.g., rat or mouse), which comprises a humanized LoH locus, produces an antibody comprising, inter alia, immunoglobulin chains, where each immunoglobulin chain comprises a human light chain variable domain operably linked to a rodent (e.g., rat or mouse) heavy chain constant domain, e.g., in response to antigenic stimulation.

In some embodiments of the methods, a genetically modified rodent (e.g., rat or mouse) comprises in its genome (e.g., its germline genome), a humanized immunoglobulin light chain locus comprising one or more human $V_L$ gene segments and one or more human $J_L$ gene segments that are upstream of (e.g., operably linked to) one or more immunoglobulin light chain constant region genes. In some embodiments, one or more human $V_L$ gene segments and one or more human $J_L$ gene segments are one or more human Vκ gene segments and one or more human Jκ gene segments. In some embodiments, one or more human $V_L$ gene segments and one or more human $J_L$ gene segments are one or more human Vλ gene segments and one or more human Jλ gene segments. In some embodiments, one or more immunoglobulin light chain constant region genes is or comprises a Cκ. In some embodiments, one or more immunoglobulin light chain constant region genes is or comprises a Cλ.

In some embodiments of the methods, a genetically modified rodent (e.g., rat or mouse) comprises in its genome (e.g., its germline genome) a humanized immunoglobulin light chain locus comprising one or more human Vκ gene segments and one or more human Jκ gene segments that are upstream of (e.g., operably linked to) a Cκ gene. Such a humanized immunoglobulin heavy chain locus is referred to herein as a "humanized KoK locus." In some embodiments, an immunoglobulin κ light chain constant region gene of a humanized KoK locus is a rodent (e.g., rat or mouse) Cκ gene. In some embodiments, an immunoglobulin κ light chain constant region gene of a humanized KoK locus is an endogenous rodent (e.g., rat or mouse) Cκ gene. In some embodiments, an immunoglobulin κ light chain constant region gene of a humanized KoK locus is an endogenous rodent (e.g., rat or mouse) Cκ gene at an endogenous immunoglobulin κ light chain locus. In some embodiments, a genetically modified rodent (e.g., rat or mouse) is homozygous at a humanized KoK locus. In some embodiments, a genetically modified rodent (e.g., rat or mouse) is heterozygous at a humanized KoK locus.

In some embodiments of the methods, a genetically modified rodent (e.g., rat or mouse), which comprises a humanized KoK locus, produces an antibody comprising, inter alia, κ light chains, where each κ light chain comprises a human κ light chain variable domain operably linked to a rodent (e.g., rat or mouse) κ light chain constant domain, e.g., in response to antigenic stimulation.

In some embodiments of the methods, a genetically modified rodent (e.g., rat or mouse) comprises in its genome (e.g., its germline genome) a humanized immunoglobulin light chain locus comprising one or more human Vλ gene segments upstream of (e.g., operably linked to) one or more human Jλ gene segments and one or more Cλ genes. Such a humanized immunoglobulin light chain locus is referred to herein as a "humanized LoL locus." In some embodiments, the one or more human Jλ gene segments and one or more Cλ genes of a humanized LoL locus are present in Jλ-Cλ clusters. In some embodiments, one or more Cλ genes of a humanized LoL locus comprise one or more human Cλ genes. In some embodiments, one or more Cλ genes of a humanized LoL locus comprise one or more mouse Cλ genes. In some embodiments, one or more Cλ genes of a humanized LoL locus comprise one or more human Cλ genes and one or more mouse Cλ genes. In some embodiments, one or more mouse Cλ genes of a humanized LoL locus comprise a mouse Cλ1 gene. In some embodiments, a genetically modified rodent (e.g., rat or mouse) is homozygous at a humanized LoL locus. In some embodiments, a genetically modified rodent (e.g., rat or mouse) is heterozygous at a humanized LoL locus.

In some embodiments of the methods, a genetically modified rodent (e.g., rat or mouse), which comprises a humanized LoL locus, produces an antibody comprising, inter alia, λ light chains, where each λ light chain comprises a human λ light chain variable domain operably linked to a rodent (e.g., rat or mouse) λ light chain constant domain, e.g., in response to antigenic stimulation. In some embodiments of the methods, a genetically modified rodent (rat or mouse), which comprises a humanized LoL locus, produces an antibody comprising, inter alia, λ light chains, where each λ light chain comprises a human λ light chain variable domain operably linked to a human λ light chain constant domain, e.g., in response to antigenic stimulation.

In some embodiments of the methods, a genetically modified rodent (e.g., rat or mouse) comprises in its genome (e.g., its germline genome) a humanized immunoglobulin light chain locus comprising one or more human Vλ gene segments and one or more human Jλ gene segments upstream of (e.g., operably linked to) a Cκ gene. Such a humanized immunoglobulin light chain locus is referred to herein as a "humanized LoK locus." In some embodiments, a Cκ gene of a humanized LoK locus is a rodent (e.g., rat or mouse) Cκ gene. In some embodiments, a Cκ gene of a humanized LoK locus is an endogenous rodent (e.g., rat or mouse) Cκ gene. In some embodiments, a Cκ gene of a humanized LoK locus is an endogenous rodent (e.g., rat or mouse) Cκ gene at an endogenous immunoglobulin κ light chain locus. In some embodiments, a genetically modified rodent (e.g., rat or mouse) is homozygous at a humanized LoK locus. In some embodiments, a genetically modified rodent (e.g., rat or mouse) is heterozygous at a humanized LoK locus.

In some embodiments of the methods, a genetically modified rodent (e.g., rat or mouse), which comprises a humanized LoK locus, produces an antibody comprising, inter alia, light chains, where each light chain comprises a human λ light chain variable domain operably linked to a rodent (e.g., rat or mouse) κ light chain constant domain, e.g., in response to antigenic stimulation.

In some embodiments of the methods, a genetically modified rodent (e.g., rat or mouse) comprises in its genome (e.g., its germline genome) a humanized immunoglobulin κ light chain locus comprising one or more human Vλ gene segments and one or more human Jλ gene segments upstream of (e.g., operably linked to) a Cλ gene. Such a humanized immunoglobulin light chain locus is referred to herein as a "humanized LiK locus." In some embodiments, a Cλ gene of a humanized LiK locus is a rodent (e.g., rat or mouse) Cλ gene. In some embodiments, a Cλ gene of a humanized LiK locus is a mouse Cλ1 gene. In some embodiments, a genetically modified rodent (e.g., rat or mouse) is homozygous at a humanized LiK locus. In some embodiments, a genetically modified rodent (e.g., rat or mouse) is heterozygous at a humanized LiK locus.

In some embodiments of the methods, a genetically modified rodent (e.g., rat or mouse), which comprises a humanized LiK locus, produces an antibody comprising, inter alia, λ light chains, where each λ light chain comprises a human λ light chain variable domain operably linked to a rodent (e.g., rat or mouse) λ light chain constant domain, e.g., in response to antigenic stimulation.

In some embodiments, a genetically modified rodent (e.g., rat or mouse) comprises in its genome (e.g., its germline genome) a humanized immunoglobulin κ light chain locus comprising one or more human Vλ gene segments upstream of (e.g., operably linked to) one or more human Jλ gene segments and one or more human Cλ genes. In some embodiments, the one or more human Jλ gene segments and one or more Cλ genes of such a humanized immunoglobulin κ light chain locus are present in Jλ-Cλ clusters. In some embodiments, a genetically modified rodent (e.g., rat or mouse) is homozygous for such a humanized immunoglobulin κ light chain locus. In some embodiments, a genetically modified rodent (e.g., rat or mouse) is heterozygous for such a humanized immunoglobulin κ light chain locus. In some embodiments, a genetically modified rodent (e.g., rat or mouse), which comprises such a humanized immunoglobulin κ light chain locus, produces an antibody comprising, inter alia, λ light chains, where each λ light chain comprises a human λ light chain variable domain operably linked to a human λ light chain constant domain, e.g., in response to antigenic stimulation.

In some embodiments of the methods, a genetically modified rodent (e.g., rat or mouse) comprises in its genome (e.g., its germline genome) a humanized HoH locus and a humanized KoK locus. In some embodiments, a genetically modified rodent (e.g., rat or mouse) comprises in its genome (e.g., its germline genome) a humanized HoH locus and a humanized LoL, locus. In some embodiments, a genetically modified rodent (e.g., rat or mouse) comprises in its genome (e.g., its germline genome) a humanized HoH locus, a humanized KoK locus, and a humanized LoL locus. In some embodiments, a genetically modified rodent (e.g., rat or mouse) is homozygous at a humanized HoH locus, a humanized KoK locus, a humanized LoL locus, or a combination thereof.

In some embodiments of the methods, a genetically modified rodent (e.g., rat or mouse) comprises in its genome (e.g., its germline genome) a humanized HoH locus, a humanized KoK locus, and a humanized LoK locus. In some embodiments, a genetically modified rodent (e.g., rat or mouse) comprises in its genome (e.g., its germline genome) a humanized HoH locus, a humanized KoK locus, and a humanized LiK locus.

In some embodiments of the methods, a genetically modified rodent (e.g., rat or mouse) comprises in its genome (e.g., its germline genome) a humanized HoH locus and a humanized LoK locus. In some embodiments, a genetically modified rodent (e.g., rat or mouse) is homozygous at a humanized HoH locus, a humanized LoK locus, or a combination thereof.

In some embodiments of the methods, a genetically modified rodent (e.g., rat or mouse) comprises in its genome (e.g., its germline genome) a humanized HoH locus and a humanized LiK locus. In some embodiments, a genetically modified rodent (e.g., rat or mouse) is homozygous at a humanized HoH locus, a humanized LiK locus, or a combination thereof.

In some embodiments of the methods, a genetically modified rodent (e.g., rat or mouse) comprises in its genome (e.g., its germline genome) a humanized LoH locus and a humanized KoK locus. In some embodiments, a genetically modified rodent (e.g., rat or mouse) comprises in its genome (e.g., its germline genome) a humanized LoH locus and a humanized LoL locus. In some embodiments, a genetically modified rodent (e.g., rat or mouse) comprises in its genome (e.g., its germline genome) a humanized LoH locus, a humanized KoK locus, and a humanized LoL locus. In some embodiments, a genetically modified rodent (e.g., rat or mouse) is homozygous at a humanized LoH locus, a humanized KoK locus, a humanized LoL locus, or a combination thereof.

In some embodiments of the methods, a genetically modified rodent (e.g., rat or mouse) comprises in its genome (e.g., its germline genome) a humanized LoH locus, a humanized KoK locus, and a humanized LoK locus. In some embodiments, a genetically modified rodent (e.g., rat or mouse) comprises in its genome (e.g., its germline genome) a humanized LoH locus, a humanized KoK locus, and a humanized LiK locus.

In some embodiments of the methods, a genetically modified rodent (e.g., rat or mouse) comprises in its genome (e.g., its germline genome) a humanized LoH locus and a humanized LoK locus. In some embodiments, a genetically modified rodent (e.g., rat or mouse) is homozygous at a humanized LoH locus, a humanized LoK locus, or a combination thereof.

In some embodiments of the methods, a genetically modified rodent (e.g., rat or mouse) comprises in its genome (e.g., its germline genome) a humanized LoH locus and a humanized LiK locus. In some embodiments, a genetically modified rodent (e.g., rat or mouse) is homozygous at a humanized LoH locus, a humanized LiK locus, or a combination thereof.

In some embodiments of the methods, a genetically modified rodent (e.g., rat or mouse) as provided herein has a genome (e.g., a germline genome) comprising a humanized immunoglobulin heavy chain (e.g., HoH or LoH) locus lacking a functional endogenous rodent Adam6 gene. In some embodiments, a genetically modified rodent (e.g., rat or mouse) as provided herein has a genome (e.g., a germline genome) comprising one or more nucleotide sequences encoding one or more rodent ADAM6 polypeptides, functional orthologs, functional homologs, or functional fragments thereof. In some embodiments, a genetically modified rodent (e.g., rat or mouse) as provided expresses one or more rodent (e.g., rat or mouse) ADAM6 polypeptides, functional orthologs, functional homologs, or functional fragments thereof. In some embodiments, a genetically modified rodent (e.g., rat or mouse) as provided has a genome (e.g., a germline genome) rising one or more nucleotide sequences encoding one or more rodent (e.g., rat or mouse) ADAM6 polypeptides, functional orthologs, functional homologs, or functional fragments thereof that are included on the same chromosome as a humanized immunoglobulin heavy chain (e.g., HoH or LoH) locus. In some embodiments, a genetically modified rodent (e.g., rat or mouse) as provided has a genome (e.g., a germline genome) comprising a humanized immunoglobulin heavy chain (e.g., HoH or LoH) locus comprising one or more nucleotide sequences encoding one or more rodent ADAM6 polypeptides, functional orthologs, functional homologs, or functional fragments thereof. In some embodiments, a genetically modified rodent (e.g., rat or mouse) as provided has a genome (e.g., a germline genome) comprising one or more nucleotide sequences encoding one or more rodent (e.g., rat or mouse) ADAM6 polypeptides, functional orthologs, functional homologs, or functional fragments thereof in place of a human Adam6 pseudogene. In some embodiments, a genetically modified rodent (e.g., rat or mouse) as provided has a genome (e.g., germline genome) comprising one or more nucleotide sequences encoding one or more rodent (e.g., rat or mouse) ADAM6 polypeptides, functional orthologs, functional homologs, or functional fragments thereof that replace a human Adam6 pseudogene.

In some embodiments of the methods, a genetically modified rodent as provided has a genome (e.g., a germline genome) comprising one or more human $V_H$ gene segments comprising a first and a second human $V_H$ gene segment, and one or more nucleotide sequences encoding one or more rodent (e.g., rat or mouse) ADAM6 polypeptides, functional orthologs, functional homologs, or functional fragments thereof between the first human $V_H$ gene segment and the second human $V_H$ gene segment. In some embodiments, a first human $V_H$ gene segment is $V_H 1$-2 and a second human $V_H$ gene segment is $V_H 6$-1.

In some embodiments of the methods, one or more nucleotide sequences encoding one or more rodent (e.g., a rat or mouse) ADAM6 polypeptides, functional orthologs, functional homologs, or functional fragments thereof are between a human $V_H$ gene segment and a human $D_H$ gene segment.

In some embodiments of the methods, one or more nucleotide sequences encoding one or more rodent ADAM6 polypeptides restore or enhance fertility in a male rodent.

In some embodiments of the methods, a genetically modified rodent (e.g., rat or mouse) comprises an exogenous terminal deoxynucleotidyl transferase (TdT) gene. In some embodiments, a rodent (e.g., rat or mouse) that comprises an exogenous terminal deoxynucleotidyl transferase (TdT) gene can have increased antigen receptor diversity when compared to a rodent without an exogenous TdT gene.

In some embodiments of the methods, a rodent as described herein has a genome comprising an exogenous terminal deoxynucleotidyltransferase (TdT) gene operably linked to a transcriptional control element.

In some embodiments of the methods, a transcriptional control element includes a RAG1 transcriptional control element, a RAG2 transcriptional control element, an immunoglobulin heavy chain transcriptional control element, an immunoglobulin κ light chain transcriptional control element, an immunoglobulin λ light chain transcriptional control element, or any combination thereof.

In some embodiments of the methods, an exogenous TdT is located at an immunoglobulin κ light chain locus, an immunoglobulin λ light chain locus, an immunoglobulin heavy chain locus, a RAG1 locus, or a RAG2 locus.

In some embodiments of the methods, a TdT is a human TdT. In some embodiments, a TdT is a short isoform of TdT (TdTS).

In a further aspect of embodiments, disclosed herein is an isolated rodent cell or rodent tissue, whose genome comprises a nucleic acid molecule encoding a NaV1.2 protein at an endogenous rodent Scn9a locus. In some embodiments, the isolated rodent cell or rodent tissue is a mouse cell or a mouse tissue or rat cell or rat tissue. In some embodiments, the isolated rodent cell or rodent tissue is a mouse cell or a mouse tissue. In some embodiments, the isolated rodent cell or rodent tissue is a rat cell or a rat tissue.

In some embodiments, an isolated rodent cell is a rodent ES cell. In some embodiments, an isolated rodent cell is a B cell.

In some embodiments, an isolated rodent cell or rodent tissue comprises in its genome a humanized immunoglobulin heavy chain locus comprising one or more human $V_H$ gene segments, one or more human $D_H$ gene segments, and one or more human $J_H$ gene segments that are upstream of (e.g., operably linked to) one or more rodent (e.g., rat or mouse) immunoglobulin heavy chain constant region genes (e.g., one or more endogenous rodent (e.g., rat or mouse) immunoglobulin heavy chain constant region genes). Such a humanized immunoglobulin heavy chain locus is referred to herein as a "humanized HoH locus." In some embodiments, an isolated rodent cell or rodent tissue is homozygous at a humanized HoH locus. In some embodiments, an isolated rodent cell or rodent tissue is heterozygous at a humanized HoH locus.

In some embodiments, an isolated rodent cell is a B cell or splenocyte comprising a humanized HoH locus and produces an antibody comprising, inter alia, heavy chains, where each heavy chain comprises a human heavy chain variable domain operably linked to a rodent (e.g., rat or mouse) heavy chain constant domain, e.g., in response to antigenic stimulation.

In some embodiments, an isolated rodent cell or rodent tissue comprises in its genome a humanized immunoglobulin light chain locus comprising one or more human $V_L$ gene segments and one or more human $J_L$ gene segments that are upstream of (e.g., operably linked to) one or more immunoglobulin light chain constant region genes. In some embodiments, one or more human $V_L$ gene segments and one or more human $J_L$ gene segments are one or more human Vκ gene segments and one or more human Jκ gene segments. In some embodiments, one or more human $V_L$ gene segments and one or more human $J_L$ gene segments are one or more human Vλ gene segments and one or more human Jλ gene segments. In some embodiments, one or more immunoglobulin light chain constant region genes is or comprises a Cκ. In some embodiments, one or more immunoglobulin light chain constant region genes is or comprises a Cλ.

In some embodiments, an isolated rodent cell or rodent tissue comprises in its genome a humanized immunoglobulin light chain locus comprising one or more human Vκ gene segments and one or more human Jκ gene segments that are upstream of (e.g., operably linked to) a Cκ gene. Such a humanized immunoglobulin heavy chain locus is referred to herein as a "humanized KoK locus." In some embodiments, an immunoglobulin κ light chain constant region gene of a humanized KoK locus is a rodent (e.g., rat or mouse) Cκ gene. In some embodiments, an immunoglobulin κ light chain constant region gene of a humanized KoK locus is an endogenous rodent (e.g., rat or mouse) Cκ gene. In some embodiments, an immunoglobulin κ light chain constant region gene of a humanized KoK locus is an endogenous rodent (e.g., rat or mouse) Cκ gene at an endogenous immunoglobulin κ light chain locus. In some embodiments, an isolated rodent cell or rodent tissue is homozygous at a humanized KoK locus. In some embodiments, an isolated rodent cell or rodent tissue is heterozygous at a humanized KoK locus.

In some embodiments, an isolated rodent cell is a B cell or splenocyte comprising a humanized KoK locus and produces an antibody comprising, inter ilia, κ light chains, where each κ light chain comprises a human κ light chain variable domain operably linked to a rodent (e.g., rat or mouse) κ light chain constant domain, e.g., in response to antigenic stimulation.

In some embodiments, an isolated rodent cell or rodent tissue comprises in its genome a humanized immunoglobulin light chain locus comprising one or more human Vλ gene segments upstream of (e.g., operably linked to) one or more human Jλ gene segments and one or more Cλ genes. Such a humanized immunoglobulin light chain locus is referred to herein as a "humanized LoL locus." In some embodiments, the one or more human Jλ gene segments and one or more Cλ genes of a humanized LoL locus are present in Jλ-Cλ clusters. In some embodiments, one or more Cλ genes of a humanized LoL locus comprise one or more human Cλ genes. In some embodiments, one or more Cλ genes of a humanized LoL locus comprise one or more mouse Cλ genes. In some embodiments, one or more Cλ genes of a humanized LoL locus comprise one or more human Cλ genes and one or more mouse Cλ genes. In some embodiments, one or more mouse Cλ genes of a humanized LoL locus comprise a mouse Cλ1 gene. In some embodiments, an isolated rodent cell or rodent tissue is homozygous at a humanized LoL locus. In some embodiments, an isolated rodent cell or rodent tissue is heterozygous at a humanized LoL locus.

In some embodiments, an isolated rodent cell is a B cell or splenocyte comprising a humanized LoL locus and produces an antibody comprising, inter alia, λ light chains, where each λ light chain comprises a human λ light chain variable domain operably linked to a rodent (e.g., rat or mouse) λ light chain constant domain, e.g., in response to antigenic stimulation. In some embodiments, an isolated rodent cell is a B cell or splenocyte comprising a humanized LoL locus and produces an antibody comprising, inter alia, λ light chains, where each λ light chain comprises a human λ light chain variable domain operably linked to a human λ light chain constant domain, e.g., in response to antigenic stimulation.

In some embodiments, an isolated rodent cell or rodent tissue comprises in its genome a humanized immunoglobulin light chain locus comprising one or more human Vλ gene segments and one or more human Jλ gene segments upstream of (e.g., operably linked to) a Cκ gene. Such a humanized immunoglobulin light chain locus is referred to herein as a "humanized LoK locus." In some embodiments, a Cκ gene of a humanized LoK locus is a rodent (e.g., rat or mouse) Cκ gene. In some embodiments, a Cκ gene of a humanized LoK locus is an endogenous rodent rat or mouse) Cκ gene. In some embodiments, a Cκ gene of a humanized LoK locus is an endogenous rodent (e.g., rat or mouse) Cκ gene at an endogenous immunoglobulin κ light chain locus. In some embodiments, an isolated rodent cell or rodent tissue is homozygous at a humanized LoK locus. In some embodiments, an isolated rodent cell or rodent tissue is heterozygous at a humanized LoK locus.

In some embodiments, an isolated rodent cell is a B cell or splenocyte comprising a humanized LoK locus and produces an antibody comprising, inter alia, light chains, where each light chain comprises a human λ light chain variable domain operably linked to a rodent (e.g., rat or mouse) κ light chain constant domain, e.g., in response to antigenic stimulation.

In some embodiments, an isolated rodent cell or rodent tissue comprises in its genome a humanized immunoglobulin κ light chain locus comprising one or more human Vλ gene segments and one or more human Jλ gene segments upstream of (e.g., operably linked to) a Cλ gene. Such a humanized immunoglobulin light chain locus is referred to herein as a "humanized LiK locus." In some embodiments, a Cλ gene of a humanized LiK locus is a rodent (e.g., rat or mouse) Cλ gene. In some embodiments, a Cλ gene of a humanized LiK locus is a mouse Cλ1 gene. In some embodiments, an isolated rodent cell or rodent tissue is homozygous at a humanized LiK locus. In some embodiments, an isolated rodent cell or rodent tissue is heterozygous at a humanized LiK locus.

In some embodiments, an isolated rodent cell is a B cell or splenocyte comprising a humanized LiK locus and produces an antibody comprising, inter alia, λ light chains, where each λ light chain comprises a human λ light chain variable domain operably linked to a rodent (e.g., rat or mouse) λ light chain constant domain, e.g., in response to antigenic stimulation.

In some embodiments, an isolated rodent cell or rodent tissue comprises in its genome a humanized immunoglobulin κ light chain locus comprising one or more human Vλ gene segments upstream of (e.g., operably linked to) one or more human Jλ gene segments and one or more human Cλ genes. In some embodiments, the one or more human Jλ gene segments and one or more Cλ genes of such a humanized immunoglobulin κ light chain locus are present in Jλ-Cλ clusters. In some embodiments, an isolated rodent cell or rodent tissue is homozygous for such a humanized immunoglobulin κ light chain locus. In some embodiments, an isolated rodent cell or rodent tissue is heterozygous for such a humanized immunoglobulin κ light chain locus. In some embodiments, an isolated rodent cell is a B cell or splenocyte, which comprises such a humanized immunoglobulin κ light chain locus, and produces an antibody comprising, inter alia, k light chains, where each λ light chain comprises a human λ light chain variable domain operably linked to a human λ light chain constant domain, e.g., in response to antigenic stimulation.

In some embodiments, an isolated rodent cell or rodent tissue comprises in its genome a humanized HoH locus and a humanized KoK locus. In some embodiments, an isolated rodent cell or rodent tissue comprises in its genome a humanized HoH locus and a humanized LoL locus. In some embodiments, an isolated rodent cell or rodent tissue comprises in its genome a humanized HoH locus, a humanized KoK locus, and a humanized LoL locus. In some embodiments, an isolated rodent cell or rodent tissue is homozygous at a humanized HoH locus, a humanized KoK locus, a humanized LoL locus, or a combination thereof.

In some embodiments, an isolated rodent cell or rodent tissue comprises in its genome a humanized HOB locus, a humanized KoK locus, and a humanized LoK locus. In some embodiments, an isolated rodent cell or rodent tissue comprises in its genome a humanized HoH locus, a humanized KoK locus, and a humanized LiK locus.

In some embodiments, an isolated rodent cell or rodent tissue comprises in its genome a humanized HoH locus and a humanized LoK locus. In some embodiments, an isolated rodent cell or rodent tissue is homozygous at a humanized HoH locus, a humanized LoK locus, or a combination thereof.

In some embodiments, an isolated rodent cell or rodent tissue comprises in its genome a humanized HoH locus and a humanized LiK locus. In some embodiments, an isolated rodent cell or rodent tissue is homozygous at a humanized HoH locus, a humanized LiK locus, or a combination thereof.

In some embodiments, an isolated rodent cell or rodent tissue comprises in its genome a humanized LoH locus and a humanized KoK locus. In some embodiments, an isolated rodent cell or rodent tissue comprises in its genome a humanized LOH locus and a humanized LoL locus. In some embodiments, an isolated rodent cell or rodent tissue comprises in its genome a humanized LoH locus, a humanized KoK locus, and a humanized LoL locus. In some embodiments, an isolated rodent cell or rodent tissue is homozygous at a humanized LoH locus, a humanized KoK locus, a humanized LoL locus, or a combination thereof.

In some embodiments, an isolated rodent cell or rodent tissue comprises in its genome) a humanized LoH locus, a humanized KoK locus, and a humanized LoK locus. In some embodiments, an isolated rodent cell or rodent tissue comprises in its genome a humanized LoH locus, a humanized KoK locus, and a humanized LiK locus.

In some embodiments, an isolated rodent cell or rodent tissue comprises in its genome a humanized LoH locus and a humanized LoK locus. In some embodiments, an isolated rodent cell or rodent tissue is homozygous at a humanized LoH locus, a humanized LoK locus, or a combination thereof.

In some embodiments, an isolated rodent cell or rodent tissue comprises in its genome a humanized LoH locus and a humanized LiK locus. In some embodiments, an isolated rodent cell or rodent tissue is homozygous at a humanized LoH locus, a humanized LiK locus, or a combination thereof.

In some embodiments, an isolated rodent cell or rodent tissue as provided herein has a genome comprising a humanized immunoglobulin heavy chain (e.g., HoH or LoH) locus lacking an endogenous rodent Adam6 gene. In some embodiments, an isolated rodent cell or rodent tissue as provided herein has a genome comprising one or more nucleotide sequences encoding one or more rodent ADAM6 polypeptides, orthologs, homologs, or fragments thereof. In some embodiments, an isolated rodent cell or rodent tissue as provided expresses one or more rodent (e.g., rat or mouse) ADAM6 polypeptides, orthologs, homologs, or fragments thereof. In some embodiments, an isolated rodent cell or rodent tissue as provided has a genome comprising one or more nucleotide sequences encoding one or more rodent (e.g., rat or mouse) ADAM6 polypeptides, orthologs, homologs, or fragments thereof that are included on the same chromosome as a humanized immunoglobulin heavy chain (e.g., HoH or LoH) locus. In some embodiments, an isolated rodent cell or rodent tissue as provided has a genome comprising a humanized immunoglobulin heavy chain (e.g., HoH or LoH) locus comprising one or more nucleotide sequences encoding one or more rodent ADAM6 polypeptides, orthologs, homologs, or fragments thereof. In some embodiments, an isolated rodent cell or rodent tissue as provided has a genome comprising one or more nucleotide sequences encoding one or more rodent (e.g., rat or mouse) ADAM6 polypeptides, orthologs, homologs, or fragments thereof in place of a human Adam6 pseudogene. In some embodiments, an isolated rodent cell or rodent tissue as provided has a genome comprising one or more nucleotide sequences encoding one or more rodent (e.g., rat or mouse) ADAM6 polypeptides, orthologs, homologs, or fragments thereof that replace a human Adam6 pseudogene.

In some embodiments, an isolated rodent cell or rodent tissue as provided has a genome comprising one or more human $V_H$ gene segments comprising a first and a second human $V_H$ gene segment, and one or more nucleotide sequences encoding one or more rodent (e.g., rat or mouse) ADAM6 polypeptides, orthologs, homologs, or fragments thereof between the first human $V_H$ gene segment and the second human $V_H$ gene segment. In some embodiments, a first human $V_H$ gene segment is $V_H$1-2 and a second human $V_H$ gene segment is $V_H$6-1.

In some embodiments, one or more nucleotide sequences encoding one or more rodent (e.g., rat or mouse) ADAM6 polypeptides, orthologs, homologs, or fragments thereof are between a human $V_H$ gene segment and a human $D_H$ gene segment.

In some embodiments, an isolated rodent cell or rodent tissue comprises an exogenous terminal deoxynucleotidyl transferase (TdT) gene. In some embodiments, an isolated rodent cell is a B cell or splenocyte comprising an exogenous terminal deoxynucleotidyl transferase (TdT) gene and can have increased antigen receptor diversity when compared to an isolated rodent cell (e.g., B cell or splenocyte) without an exogenous TdT gene.

In some embodiments, an isolated rodent cell or rodent tissue as described herein has a genome comprising an exogenous terminal deoxynucleotidyltransferase (TdT) gene operably linked to a transcriptional control element.

In some embodiments, a transcriptional control element includes a RAG1 transcriptional control element, a RAG2 transcriptional control element, an immunoglobulin heavy chain transcriptional control element, an immunoglobulin κ light chain transcriptional control element, an immunoglobulin λ light chain transcriptional control element, or any combination thereof.

In some embodiments, an exogenous TdT is located at an immunoglobulin κ light chain locus, an immunoglobulin λ light chain locus, an immunoglobulin heavy chain locus, a RAG1 locus, or a RAG2 locus.

In some embodiments, a TdT is a human TdT. In some embodiments, a TdT is a short isoform of TdT (BITS).

In another aspect of embodiments, disclosed herein is a rodent embryo comprising a rodent ES cell described herein.

In one aspect of embodiments, disclosed herein is a targeting nucleic acid construct comprising a nucleic acid molecule encoding a NaV1.2 protein, flanked by 5' and 3' rodent nucleotide sequences capable of mediating homologous recombination and integration of the nucleic acid molecule into an endogenous rodent Scn9a locus.

In another aspect of embodiments, disclosed herein is a method of producing an anti-NaV1.7 antibody, comprising immunizing a genetically modified rodent (e.g., rat or mouse) described herein with a NaV1.7 immunogen (e.g., a human NaV1.7 immunogen). In some embodiments, a method of producing an anti-NaV1.7 antibody comprises isolating an anti-NaV1.7 antibody from an immunized rodent. In some embodiments, the antibody is a monoclonal antibody. In some embodiments, a method of producing an anti-NaV1.7 antibody comprises isolating a B cell expressing an anti-NaV1.7 antibody from an immunized rodent. In some embodiments, a hybridoma that produces an anti-human NaV1.7 antibody is also provided. In some embodiments, a hybridoma that produces an anti-human NaV1.7 antibody is derived from a B cell isolated from an immunized rodent.

In another aspect of embodiments, disclosed herein is a method of producing a human heavy and/or light chain variable domain of an anti-NaV1.7 antibody, comprising immunizing a genetically modified rodent (e.g., rat or mouse) described herein with a NaV1.7 immunogen (e.g., a human NaV1.7 immunogen). In some embodiments, a method of producing a human heavy and/or light chain variable domain of an anti-NaV1.7 antibody comprises allowing a genetically modified mouse to mount an immune response to a NaV1.7 immunogen. In some embodiments, a method of producing a human heavy and/or light chain variable domain of an anti-NaV1.7 antibody comprises isolating a B cell from the genetically modified mouse that expresses an anti-NaV1.7 antibody. In some embodiments, a method of producing a human heavy and/or light chain variable domain of an anti-NaV1.7 antibody comprises determining an amino acid sequence of a human heavy and/or light chain variable domain of an anti-NaV1.7 antibody that was generated by the genetically modified mouse. In some embodiments, a method of producing a human heavy and/or light chain variable domain of an anti-NaV1.7 antibody comprises expressing a polypeptide comprising an identified human heavy and/or light chain variable domain. In some embodiments, determining an amino acid sequence of a human heavy and/or light chain variable domain comprises determining a nucleotide sequence that encodes the human heavy and/or light chain variable domain, respectively.

In another aspect of embodiments, disclosed herein is a method of producing a human heavy and/or light chain variable region encoding a human heavy and/or light chain variable domain of an anti-NaV1.7 antibody, respectively, comprising immunizing a genetically modified rodent (e.g., rat or mouse) described herein with a NaV1.7 immunogen (e.g., a human NaV1.7 immunogen). In some embodiments, a method of producing a human heavy and/or light chain variable region encoding a human heavy and/or light chain variable domain of an anti-NaV1.7 antibody, respectively, comprises allowing a genetically modified rodent to mount an immune response to a NaV1.7 immunogen. In some embodiments, a method of producing a human heavy and/or light chain variable region encoding a human heavy and/or light chain variable domain of an anti-NaV1.7 antibody, respectively, comprises isolating a B cell from the genetically modified rodent that expresses an anti-NaV1.7 antibody. In some embodiments, a method of producing a human heavy and/or light chain variable region encoding a human heavy and/or light chain variable domain of an anti-NaV1.7 antibody, respectively, comprises determining a nucleic acid sequence of a human heavy and/or light chain variable region of an anti-NaV1.7 antibody that was generated by the genetically modified rodent.

In another aspect of embodiments, disclosed herein is a nucleic acid encoding a human heavy and/or light chain variable domain of an anti-NaV1.7 antibody identical to or obtained from a rodent (e.g., rat or mouse) described herein.

In another aspect of embodiments, disclosed herein is a nucleic acid encoding an immunoglobulin heavy chain comprising a human heavy chain variable domain of an anti-NaV1.7 antibody identical to or obtained from a rodent (e.g., rat or mouse) described herein. In some embodiments, a nucleic acid encoding an immunoglobulin heavy chain further comprises a human heavy chain constant domain. In some embodiments, a nucleic acid encoding an immunoglobulin heavy chain further comprises a rodent (e.g., rat or mouse) heavy chain constant domain.

In another aspect of embodiments, disclosed herein is a nucleic acid encoding an immunoglobulin light chain comprising a human light chain variable domain of an anti-NaV1.7 antibody identical to or obtained from a rodent (e.g., rat or mouse) described herein. In some embodiments, a nucleic acid encoding an immunoglobulin light chain further comprises a human light chain constant domain. In some embodiments, a nucleic acid encoding an immunoglobulin light chain further comprises a rodent (e.g., rat or mouse) light chain constant domain.

In another aspect of embodiments, disclosed herein is a human heavy and/or light chain variable domain of an anti-NaV1.7 antibody identical to, obtained from, or derived from a rodent (e.g., rat or mouse) described herein.

In another aspect of embodiments, disclosed herein is a mammalian cell that expresses an anti-NaV1.7 antibody that comprises a heavy chain and light chain variable domain of an anti-NaV1.7 antibody identical to, obtained from, or derived from a rodent (e.g., rat or mouse) described herein. In some embodiments, a mammalian cell is a CHO cell (e.g., CHO K1, DXB-11CHO, Veggie-CHO), COS (e.g., COS-7), retinal cell, Vero cell, CV1 cell, kidney cell (e.g., HEK293, 293 EBNA, MSR 293, MDCK, HaK BHK), HeLa cell HepG2 cell, W138 cell, MRC 5 cell, Colo205 cell, HB 8065 cell, HL-60 cell, (e.g., BHK21), Jurkat cell, Daudi cell, A431 cell (epidermal), U937 cell, 3T3 cell, L cell, C127 cell, SP2/0 cell, NS-0 cell, MMT 060562 cell, Sertoli cell, BRL 3A cell, HT1080 cell, myeloma cell, tumor cell, and a cell of a cell line derived from an aforementioned cell.

BRIEF DESCRIPTION OF THE DRAWINGS

FIGS. 1A-1D. An exemplary strategy for knocking in human SCN2A into a mouse Scn9a locus. FIG. 1A shows a diagram, not to scale, of the genomic organization of human SCN2/A and mouse Scn9a genes. Exons are represented by thin bars placed above the genomic sequences. A mouse genomic fragment of about 84,847 bp to be deleted and a human genomic fragment of about 96,735 bp to be inserted are indicated. Locations of probes used in an assay described in Table 1 of Example 1 are indicated by asterisks. FIG. 1B illustrates, not to scale, an exemplary modified BAC vector for knocking in human SCN2A into a mouse Scn9a locus, along with the junction sequences (SEQ ID NOS: 17, 18 and 19). FIG. 1C illustrates, not to scale, a humanized mouse Scn9a locus having human SCN2A knocked in after the neomycin cassette has been deleted, along with the junction sequences (SEQ ID NOS: 17 and 21). FIG. 1D sets forth a sequence alignment of amino acids 2-1984 of a mouse Scn9a (NaV1.7) protein (SEQ ID NO: 2) and amino acids 4-2005 of a human SCN2A (NaV1.2) protein (SEQ ID NO: 4).

FIG. 3A. Alignment of exemplary sequences of human NaV proteins, from top to bottom: human NaV1.1 (SEQ ID NO: 22), human NaV1.2 (SEQ ID NO: 4), human NaV1.3 (SEQ ID NO: 23), human NaV1.4 (SEQ ID NO: 24), human NaV1.5 (SEQ ID NO: 25), human NaV1.6 (SEQ ID NO: 26), human NaV1.7 (SEQ ID NO: 27), human NaV1.8 (SEQ ID NO: 28) and human NaV1.9 (SEQ ID NO: 29), respectively, Domains are labeled based on human NaV1.7. "cyto": cytoplasmic (green); "TM": transmembrane (blue); "EC": extracellular (pink); "Pore-Forming": a portion of an extracellular domain implicated in forming a pore through which ions pass (brown).

FIG. 6. shows the nucleotide sequence of the 7506 Allele (SEQ ID NO: 20), i.e., human SCN2A into mouse Scn9a locus with Neo self deleting cassette, which includes mouse nucleotides (lowercase), SgrDI site (bold, underlined), human nucleotides (bold, upper case), XhoI site (bold, underlined), LoxP (italics), Protamine Promoter (bold, underlined), Crei (italics), SV40 polyA (lowercase), hUbi prm (bold)-EM7 prm (bold, underlined), NEO (italics), PGK polyA (underlined), LoxP (italics), ICeUI (underlined), NheI (bold, underlined), mouse nucleotides (lowercase).

DETAILED DESCRIPTION

Disclosed herein are embodiments of non-human animals genetically modified to express an exogenous NaV1 protein, e.g., NaV1.2 protein. In some embodiments, a non-human animal comprises an exogenous Scn nucleotide sequence (e.g., a Scn2a gene sequence, e.g., a human SCN2A gene sequence). Also disclosed herein are embodiments of methods and compositions useful for making such genetically modified non-human animals, and embodiments of methods of using such genetically modified non-human animals for generating antibodies that bind a NaV1.7 protein (e.g., a human NaV1.7 protein) or a functional portion thereof. Scn9a is the name of the gene which encodes a NaV1.7 protein. Scn2a is the name of the gene which encodes a NaV1.2 protein. In some embodiments, a non-human animal is a rodent (e.g., a mouse or a rat).

NaV Family

The family of voltage-gated sodium channels has nine known members, with amino acid identity >50% in the trans-membrane segments and extracellular loop regions. The proteins of these channels are named NaV1.1 through NaV1.9, and the gene names are referred to as Scn1a through Scn11a. See Table 1 below.

TABLE 1

| Protein Name | Gene Name |
| --- | --- |
| NaV1.1 | Scn1a |
| NaV1.2 | Scn2a |
| NaV1.3 | Scn3a |
| NaV1.4 | Scn4a |
| NaV1.5 | Scn5a |
| NaV1.6 | Scn8a |
| NaV1.7 | Scn9a |
| NaV1.8 | Scn10a |
| NaV1.9 | Scn11a |

Figure 3A:
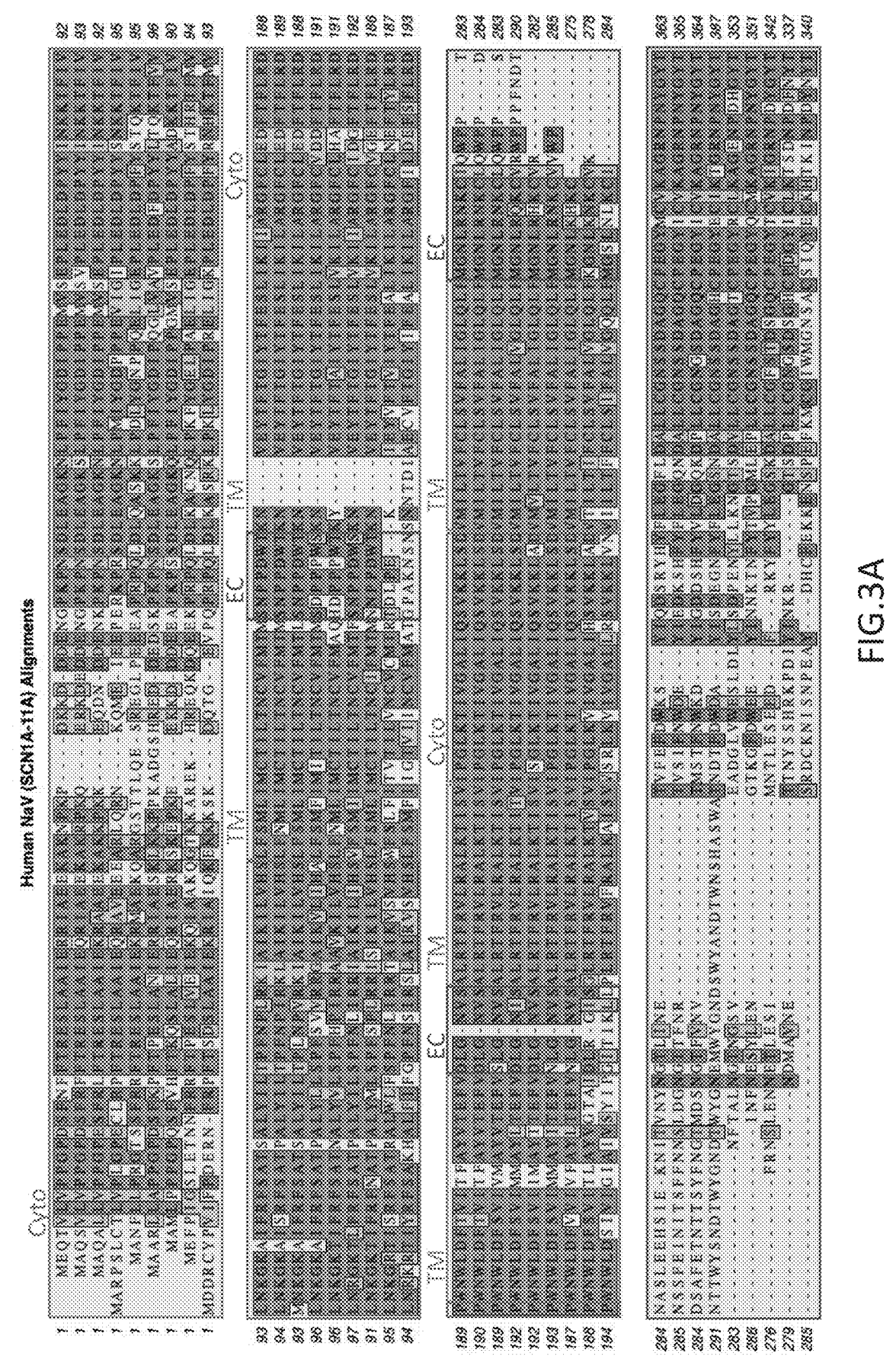
Figure 3A:
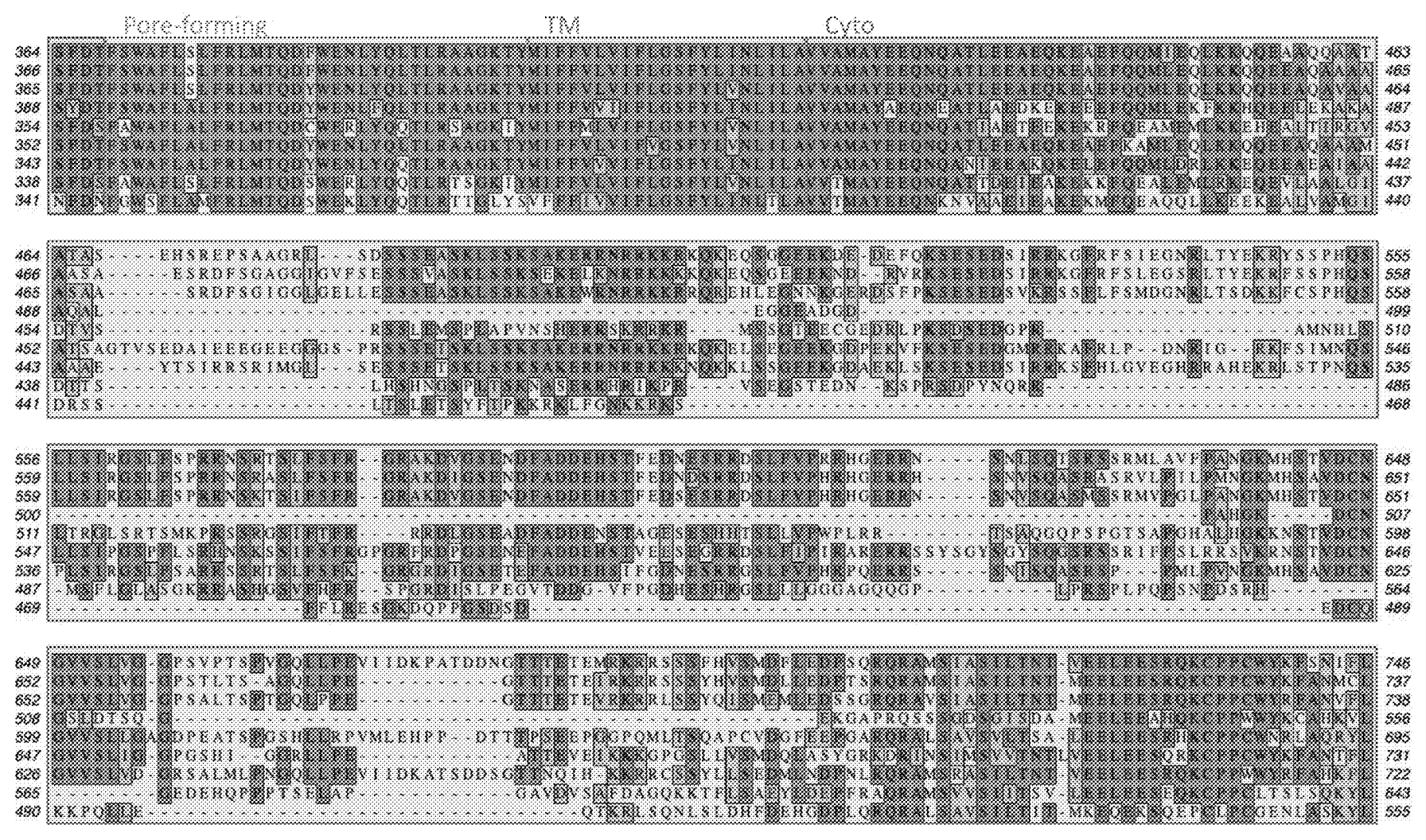
Figure 3A:
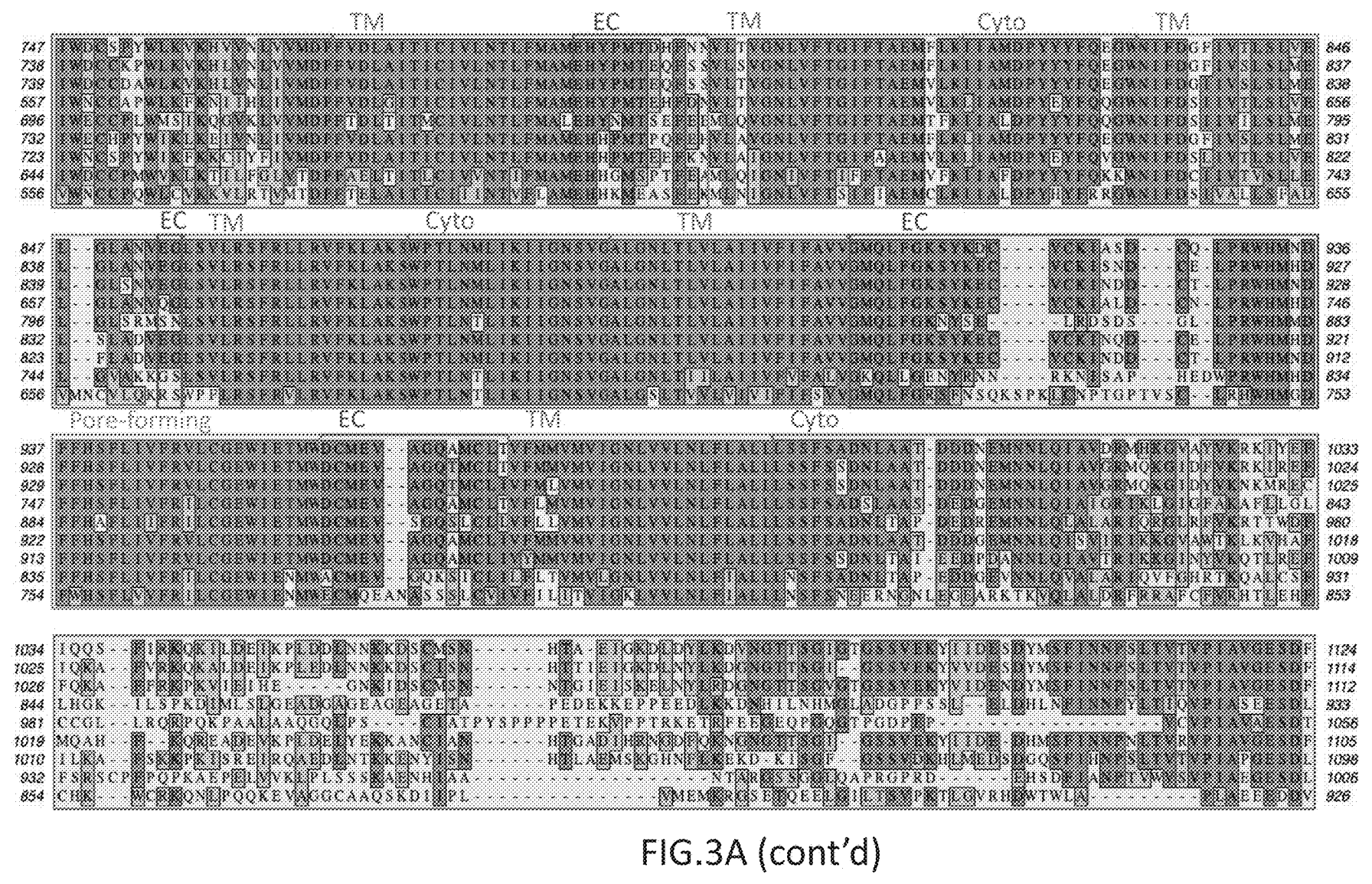
Figure 3A:
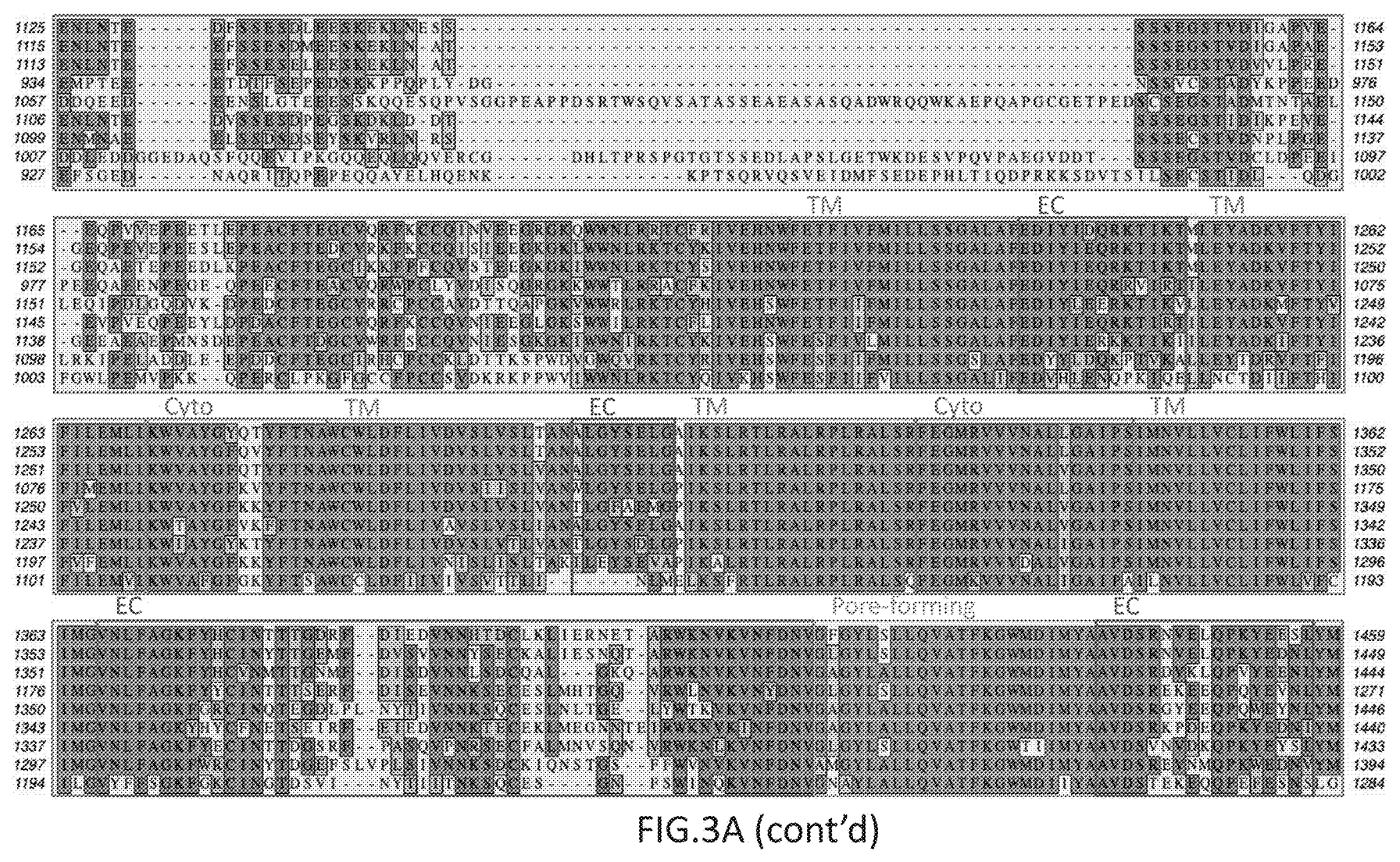
Figure 3A:
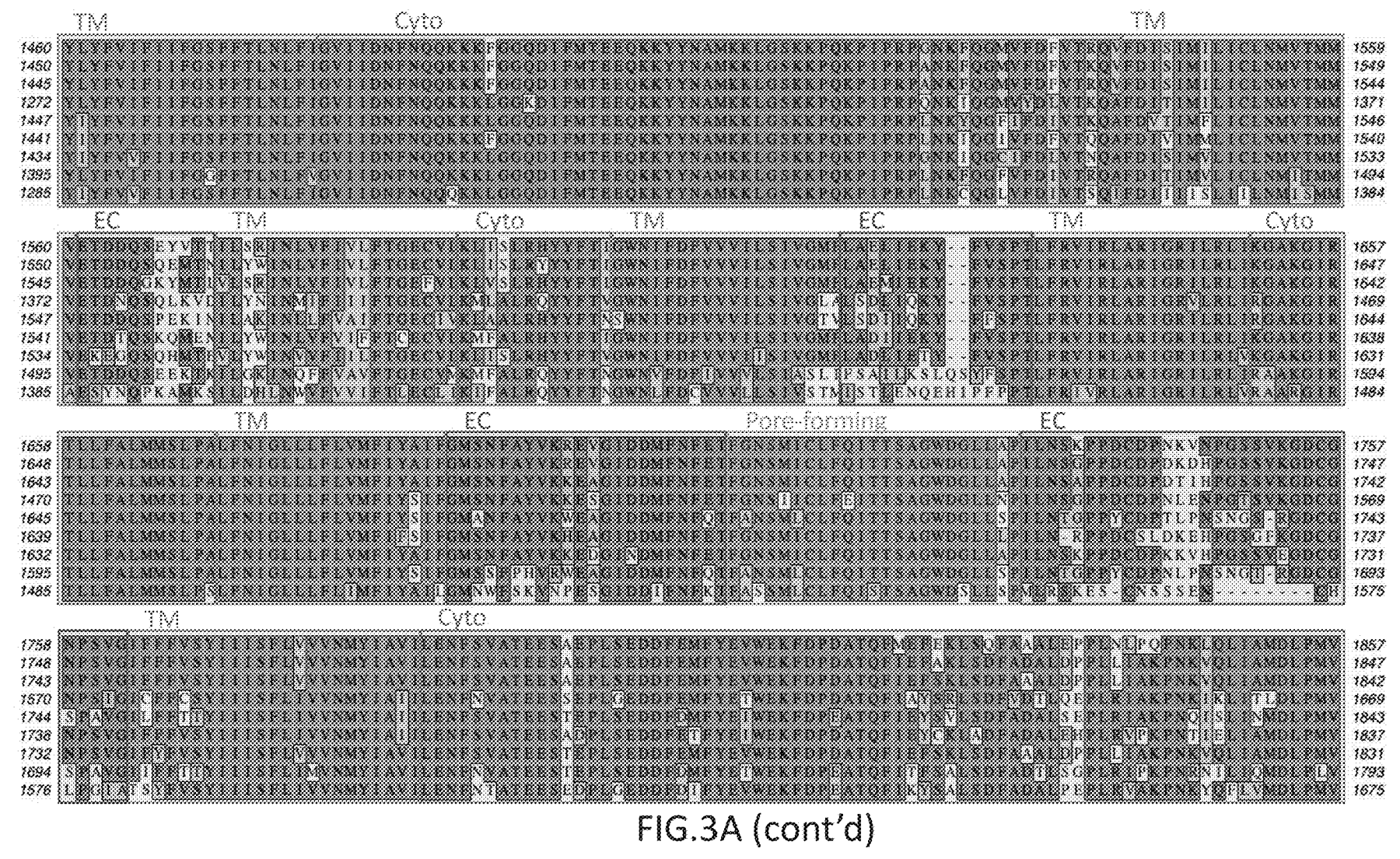
Figure 3A:
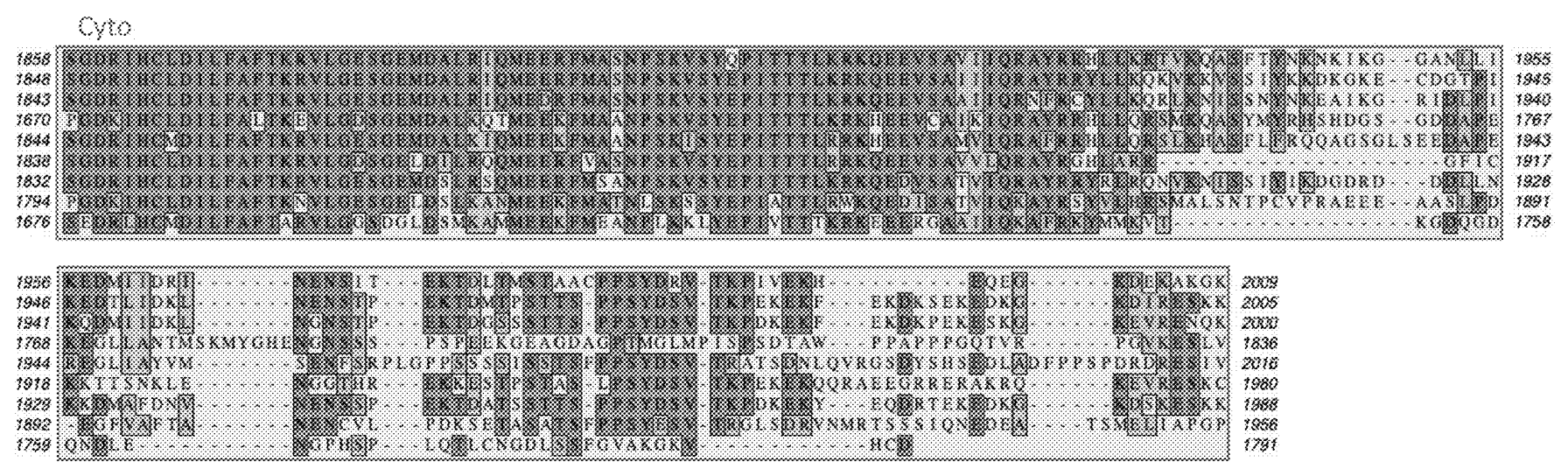
Figure 3B:
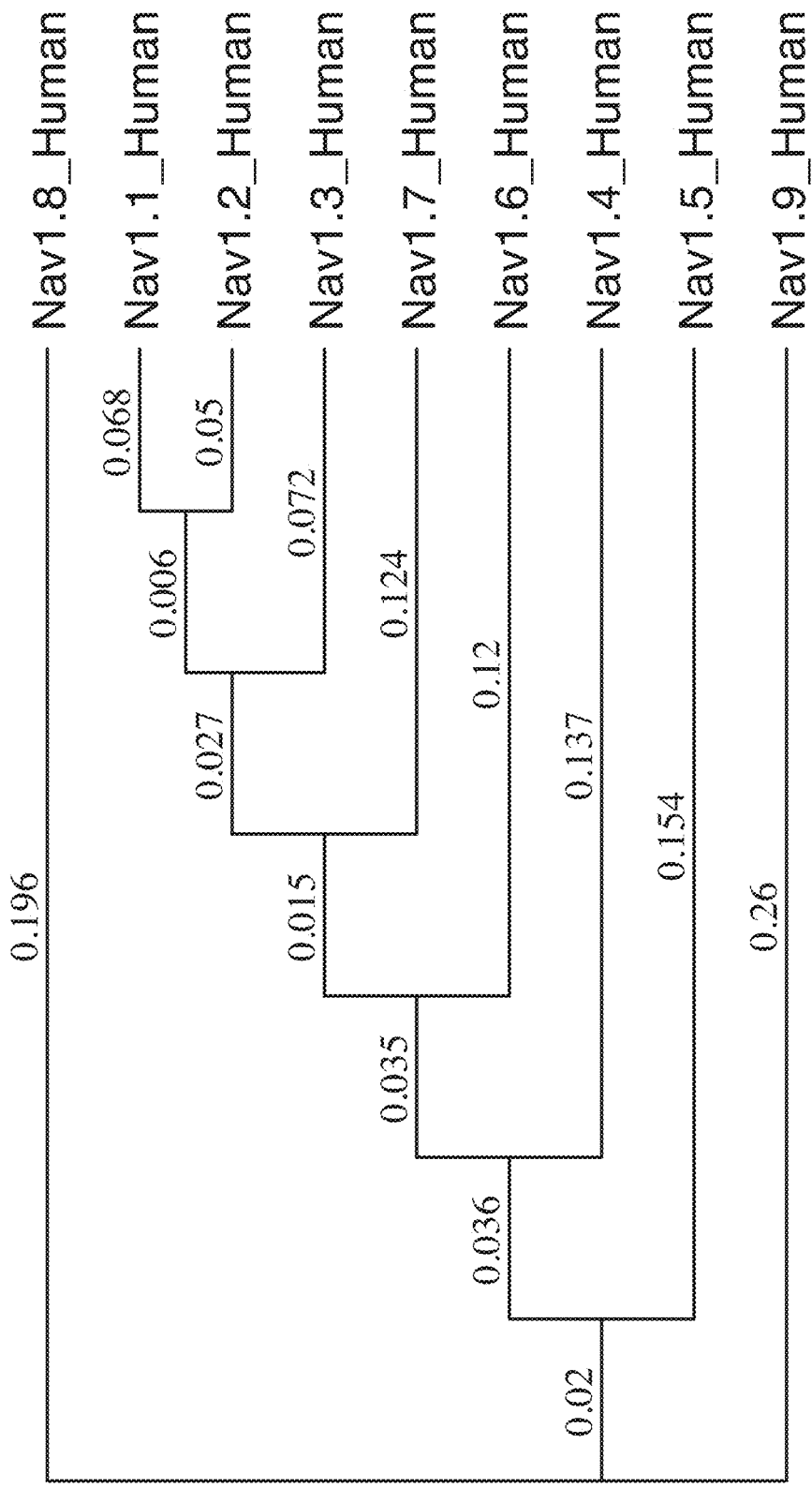
FIG. 3B. Phylogenetic tree of nine human NaV proteins.

An alignment of exemplary human NaV protein sequences is provided in FIG. 3A, with the accession numbers and sequence identifiers set forth in Table 2. The relatedness of the human NaV proteins is depicted in FIG. 3B.

TABLE 2

| Protein Name | Accession No. For Human Proteins | SEQ ID NO |
| --- | --- | --- |
| NaV1.1 | P35498.2 | SEQ ID NO: 22 |
| NaV1.2 | Q99250.3 | SEQ ID NO: 4 |
| NaV1.3 | Q9NY46.2 | SEQ ID NO: 23 |
| NaV1.4 | P35499.4 | SEQ ID NO: 24 |
| NaV1.5 | Q14524.2 | SEQ ID NO: 25 |

TABLE 2-continued

| Protein Name | Accession No. For Human Proteins | SEQ ID NO |
|---|---|---|
| NaV1.6 | Q9UQD0.1 | SEQ ID NO: 26 |
| NaV1.7 | Q15858.3 | SEQ ID NO: 27 |
| NaV1.8 | Q9Y5Y9.2 | SEQ ID NO: 28 |
| NaV1.9 | Q9UI33.2 | SEQ ID NO: 29 |

These members of the sodium channel family (see Table 1) have four repeat domains, each containing six membrane-spanning segments. See FIG. 3A. The fourth segment is highly conserved and acts as the channel's voltage sensor. The voltage sensitivity of this channel is due to positive amino acids located at every third position in the fourth segment (Nicholls et al., (2012) "From Neuron to Brain," 5th ed. pg. 86, which is herein incorporated by reference in its entirety). When stimulated by a change in transmembrane voltage, this segment moves toward the extracellular side of the cell membrane, allowing the channel to become permeable to ions. The ions are conducted through a pore, which can be broken into two regions. The more external (i.e., more extracellular) portion of the pore is formed by the region between the fifth and sixth transmembrane segments (also known as "P-loop") of each of the four domains. This region is the narrower part of the pore and is responsible for its ion selectivity. The inner portion (i.e., more cytoplasmic) of the pore is formed by the combined fifth and sixth transmembrane segments of the four domains.

NaV1.7

NaV1.7 is expressed in nociceptive (pain) neurons at dorsal root ganglion, sympathetic neurons, Schwann cells and neuroendocrine cells. NaV1.7 is a critical component of membrane excitability and important for sensation of pain. Gain of function mutations in the human SCN9A gene have been associated with pain syndromes, while loss of function mutations are associated with profound insensitivity to pain. It is desirable to develop selective NaV1.7 channel blockers as analgesics.

Figure 4A:
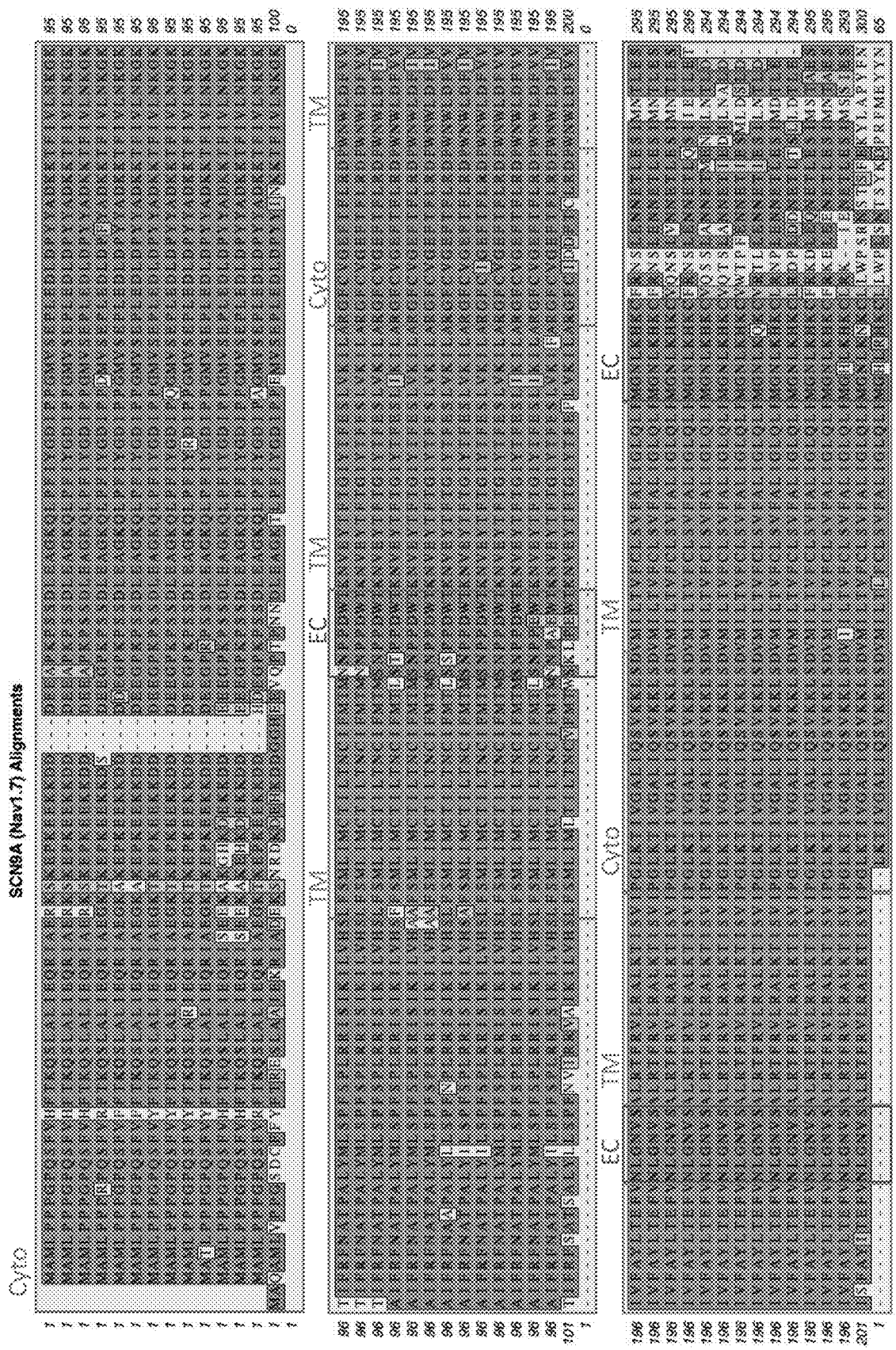
FIG. 4A. Alignment of exemplary sequences of NaV1.7 proteins from 15 animal species, from top to bottom: human (SEQ ID NO: 27), chimpanzee (isoform X1) (SEQ ID NO: 30), rhesus monkey (SEQ ID NO: 31), sunda flying lemur (isoform X1) (SEQ ID NO: 32), cattle (SEQ ID NO: 33), sheep (isoform X1) (SEQ ID NO: 34), arabian camel (SEQ ID NO: 35), killer whale (isoform X1) (SEQ ID NO: 36), horse (SEQ ID NO: 37), dog (isoform X1) (SEQ ID NO: 38), mouse (SEQ ID NO: 2), rat (SEQ ID NO: 39), rabbit (SEQ ID NO: 40), chicken (SEQ ID NO: 41, and king cobra (partial) (SEQ ID NO: 42), respectively. "cyto": cytoplasmic (green); "TM": transmembrane (blue); "EC": extracellular (pink); "Pore-Forming": a portion of an extracellular domain implicated in forming a pore through which ions pass (brown).
Figure 4A:
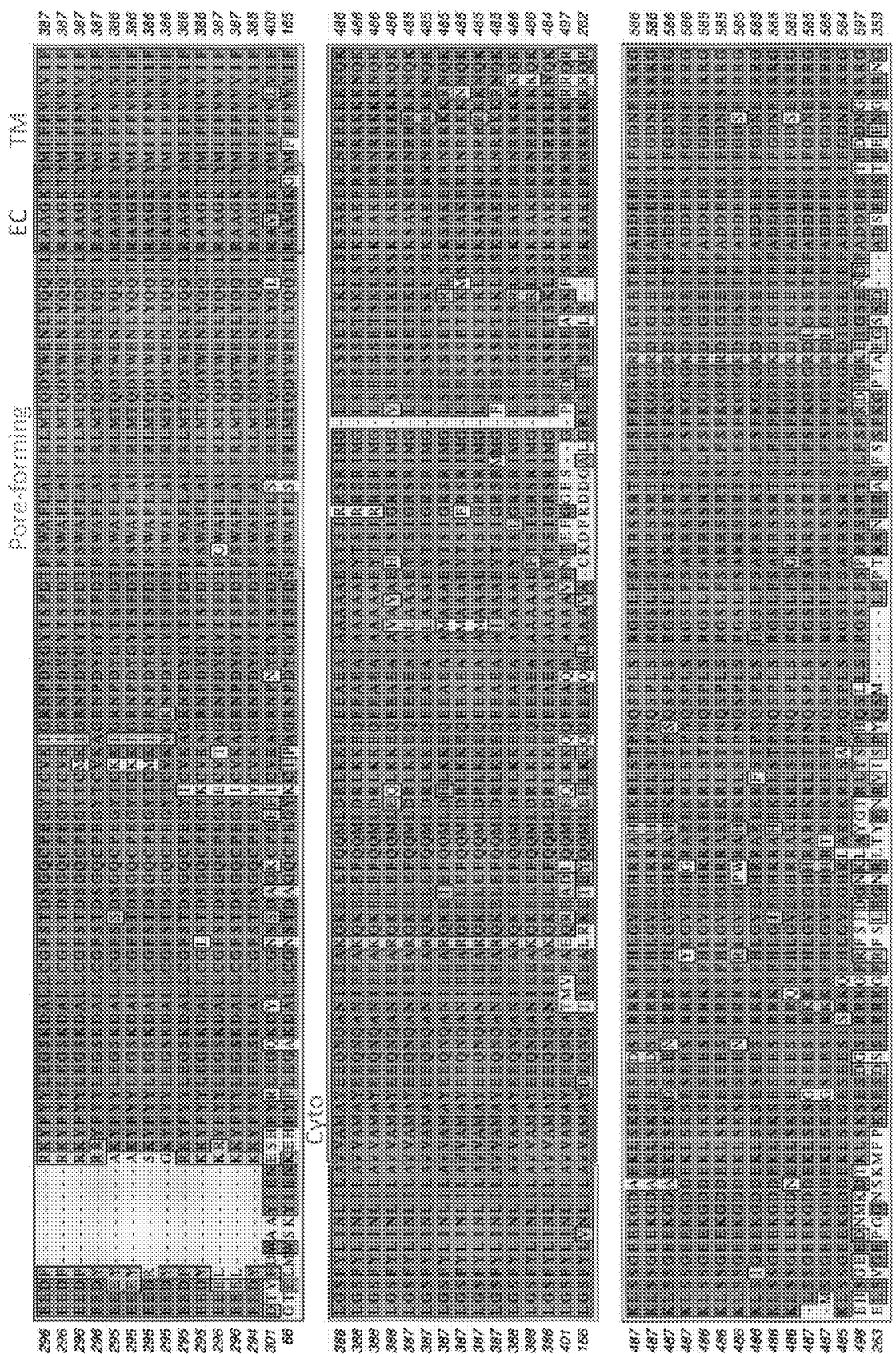
Figure 4A:
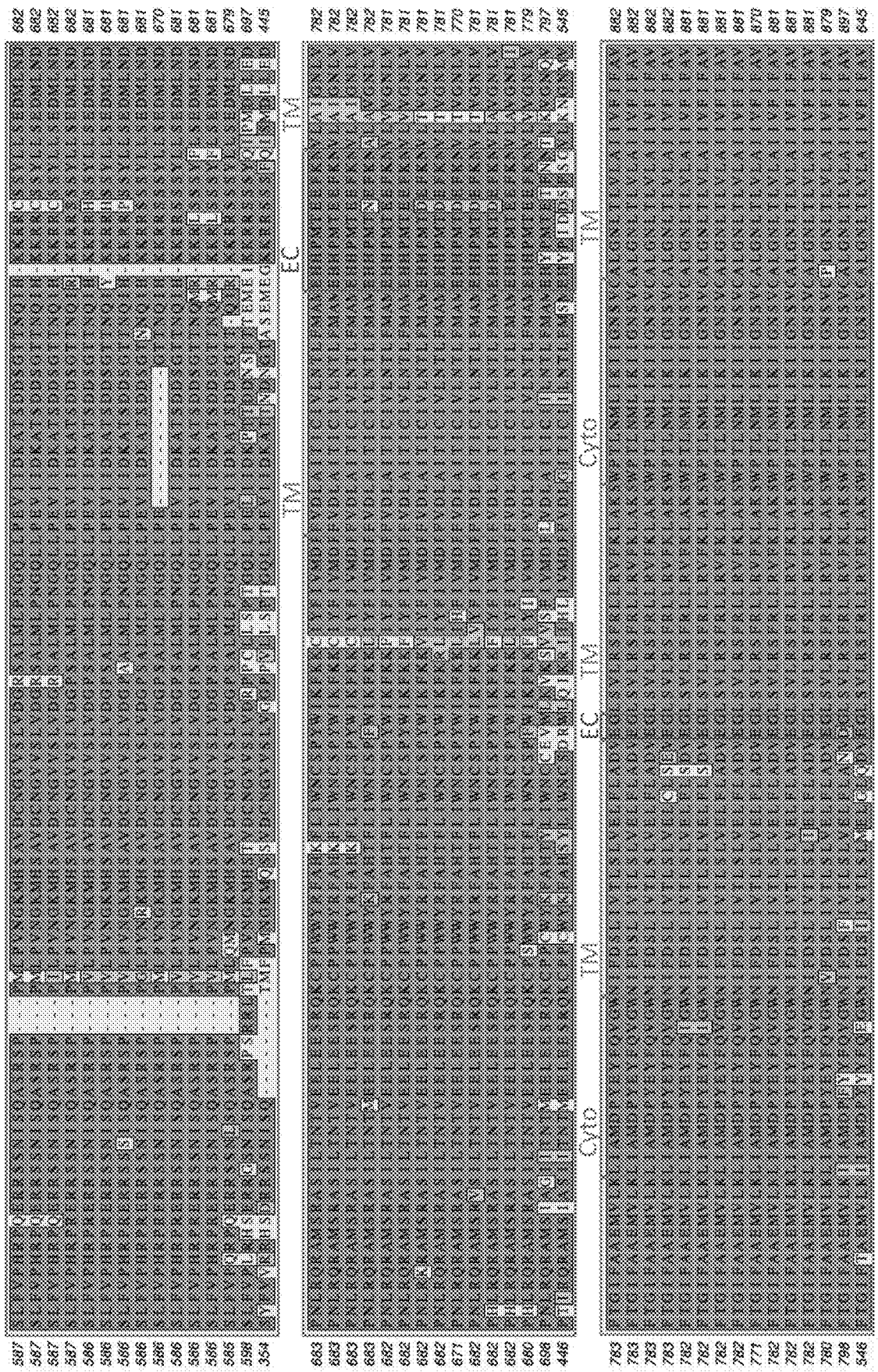
Figure 4A:
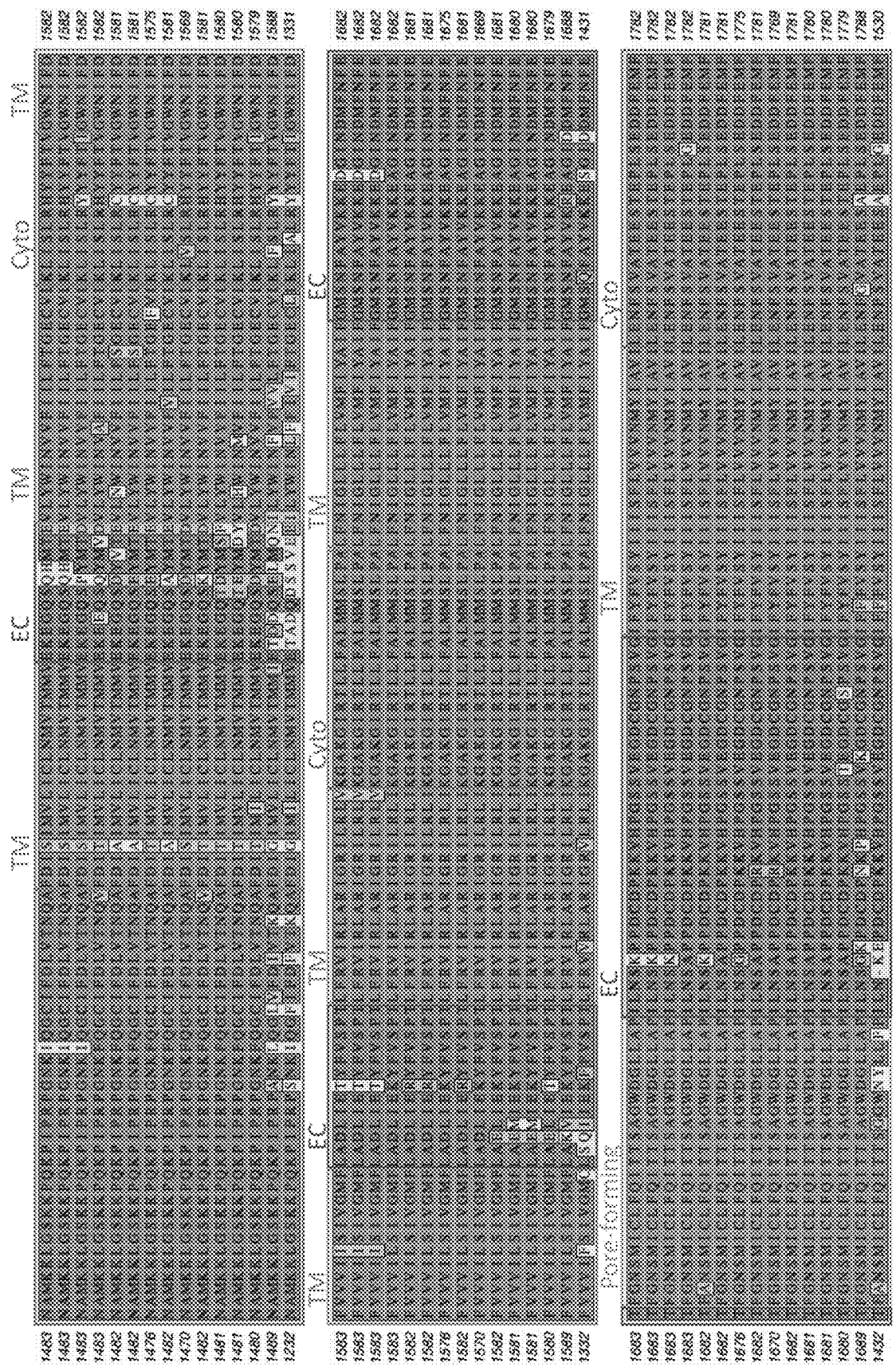
Figure 4A:
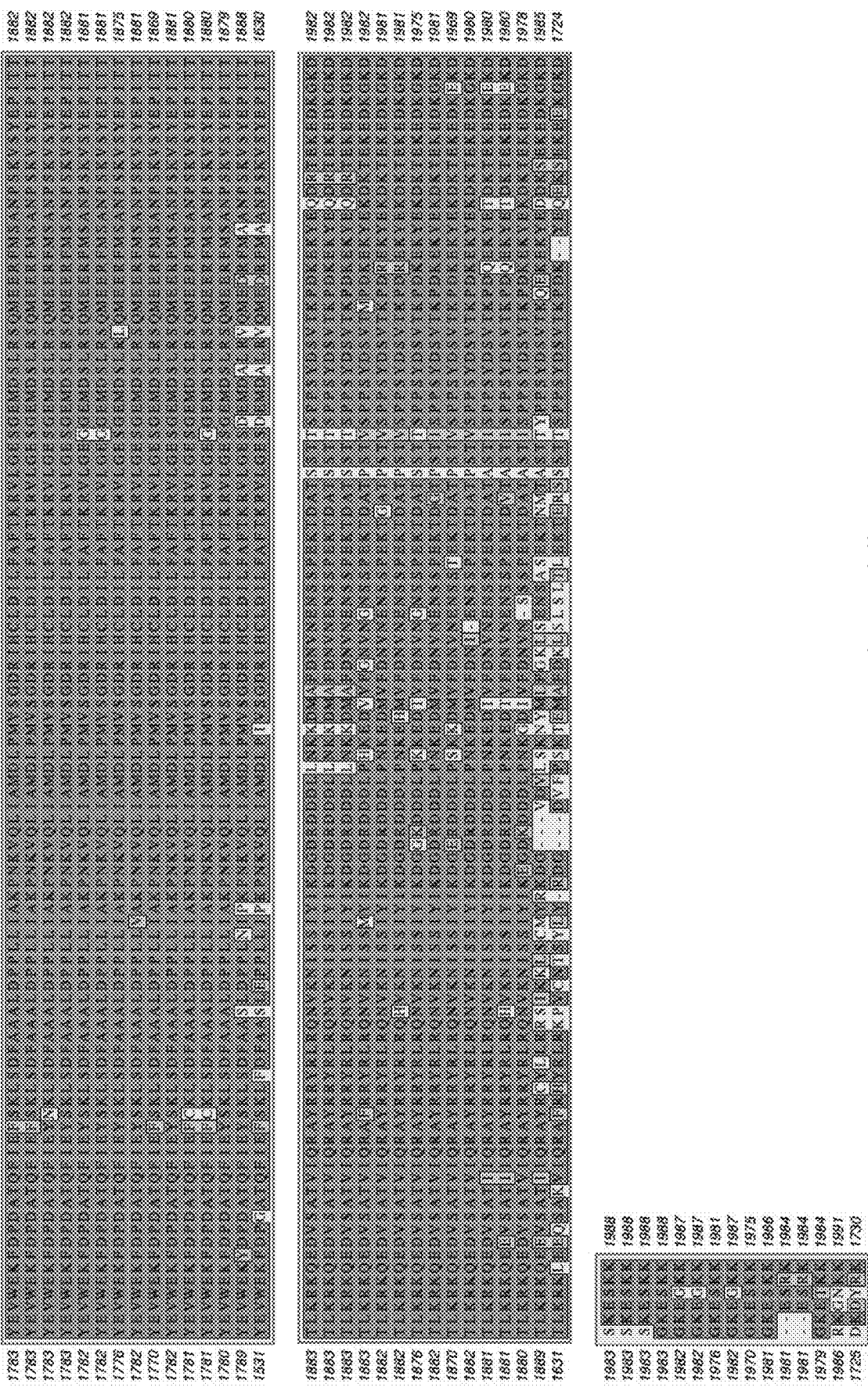
Figure 4B:
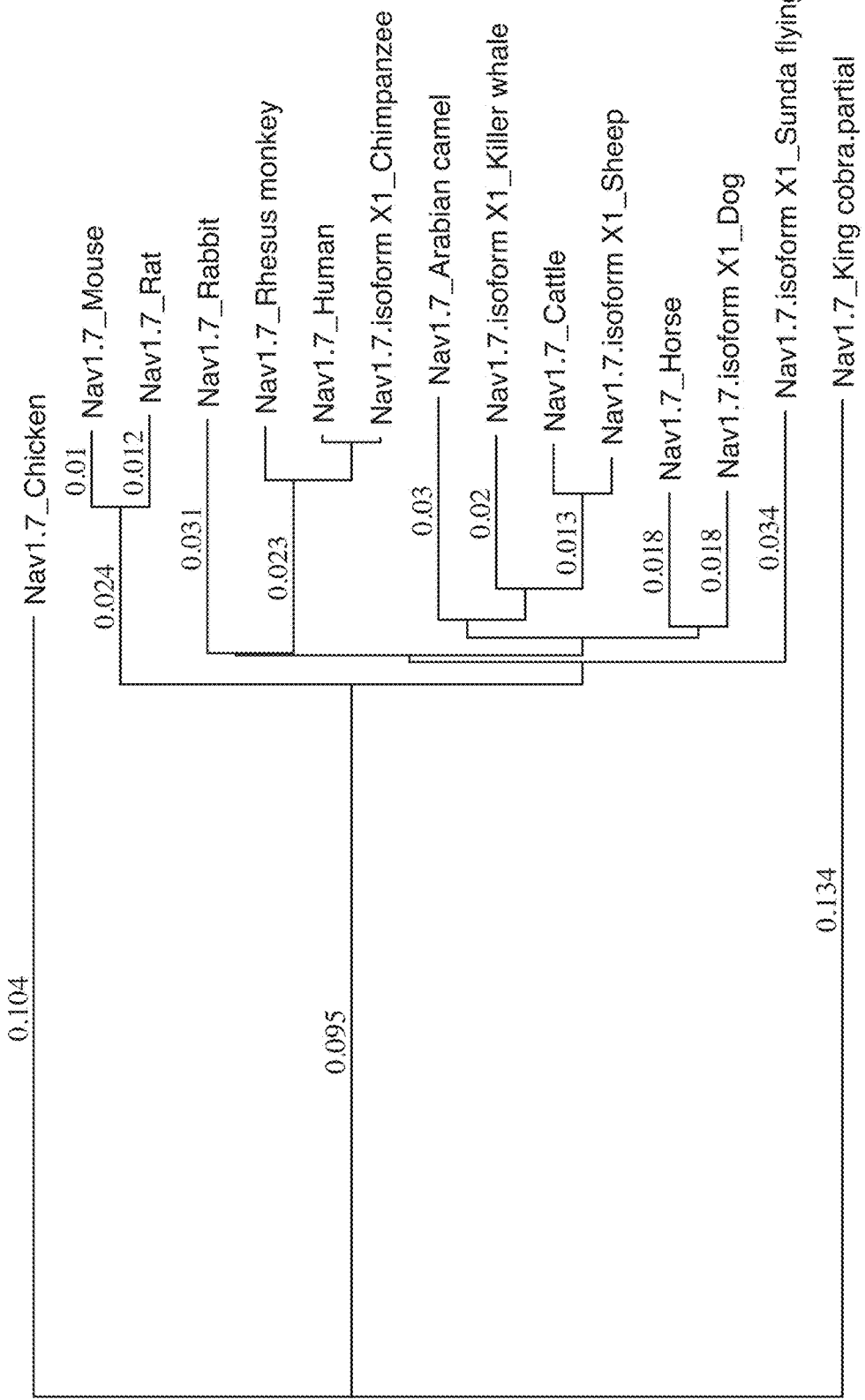
FIG. 4B. Phylogenetic tree of NaV1.7 proteins from 15 animal species.

NaV1.7 is highly conserved across species, as evident from an alignment of exemplary sequences of NaV1.7 proteins from 15 animal species in FIG. 4A and a relationship tree in FIG. 4B. The accession numbers and sequence identifiers for the exemplary sequences included in the alignment are set forth below in Table 3.

TABLE 3

| Species of NaV1.7 | Accession No. | SEQ ID NO |
|---|---|---|
| Human | Q15858.3 | SEQ ID NO: 27 |
| Chimpanzee | XP_016804947.1 | SEQ ID NO: 30 |
| Rhesus monkey | XP_014965766.1 | SEQ ID NO: 31 |
| Sunda flying lemur | XP_008588371.1 | SEQ ID NO: 32 |
| Cattle | NP_001104257.2 | SEQ ID NO: 33 |
| Sheep | XP_004004679.1 | SEQ ID NO: 34 |
| Arabian camel | XP_010980767.1 | SEQ ID NO: 35 |
| Killer whale | XP_004267302.1 | SEQ ID NO: 36 |
| Horse | XP_001496473.1 | SEQ ID NO: 37 |
| Dog | XP_022270547.1 | SEQ ID NO: 38 |
| Mouse | Q62205.2 | SEQ ID NO: 2 |
| Rat | O08562.1 | SEQ ID NO: 39 |
| Rabbit | Q28644.1 | SEQ ID NO: 40 |
| Chicken | NP_001280211.1 | SEQ ID NO: 41 |
| King cobra (partial sequence) | DAA65084.1 | SEQ ID NO: 42 |

NaV1.2

NaV1.2 is expressed in central neurons and peripheral neurons. Mutations in the human SCN2A gene (encoding NaV1.2) have been linked to several seizure disorders and autism spectrum disorder.

Figure 5A:
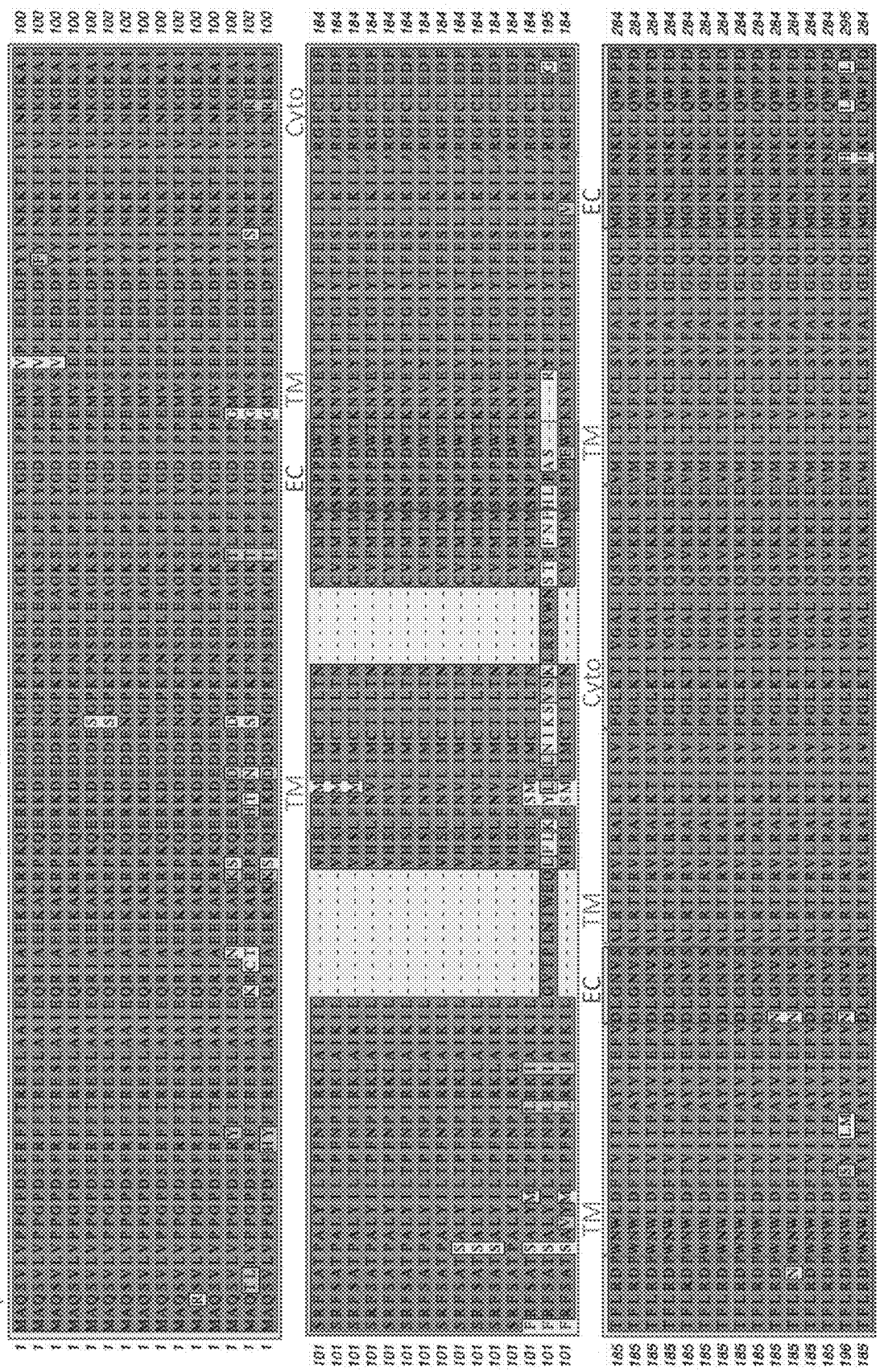
FIG. 5A. Alignment of exemplary sequences of NaV1.2 proteins from 15 animal species, from top to bottom: human (SEQ ID NO: 4), chimpanzee (isoform X1) (SEQ ID NO: 43), rhesus monkey (isoform X1) (SEQ ID NO: 44), sunda flying lemur (isoform X1) (SEQ ID NO: 45), cattle (SEQ ID NO: 46), sheep (isoform X1) (SEQ ID NO: 47), arabian camel (SEQ ID NO: 48), killer whale (isoform 1) (SEQ ID NO: 49), horse (SEQ ID NO: 50), mouse (isoform 1) (SEQ ID NO: 51), rat (SEQ ID NO: 52), rabbit (isoform X1) (SEQ ID NO: 53), chicken (SEQ ID NO: 54), king cobra (partial) (SEQ ID NO: 55), and green sea turtle (SEQ ID NO: 56), respectively. "cyto": cytoplasmic (green); "TM": transmembrane (blue); "EC": extracellular (pink); "Pore-Forming": a portion of an extracellular domain implicated in forming a pore through which ions pass (brown).
Figure 5A:
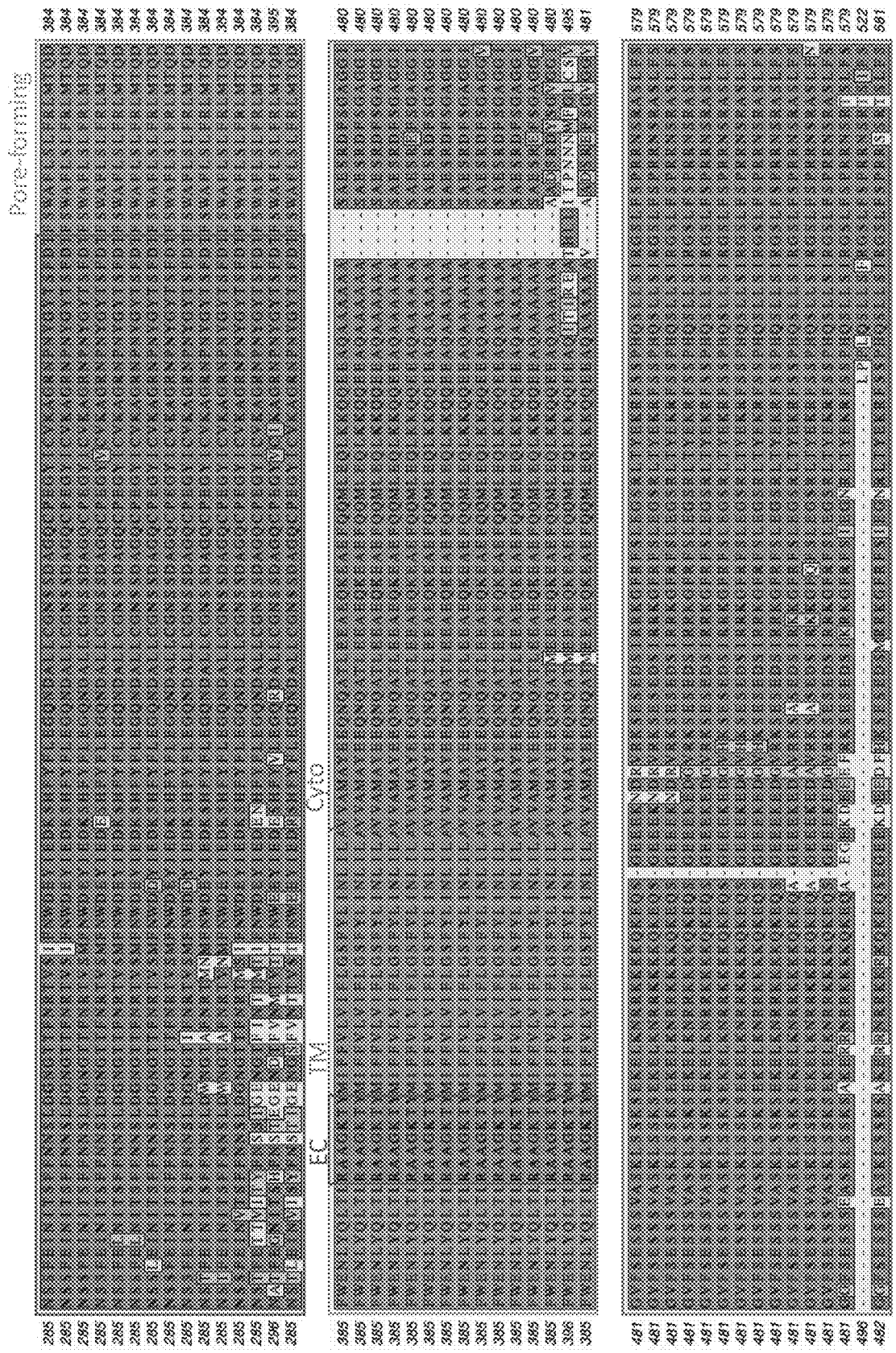
Figure 5A:
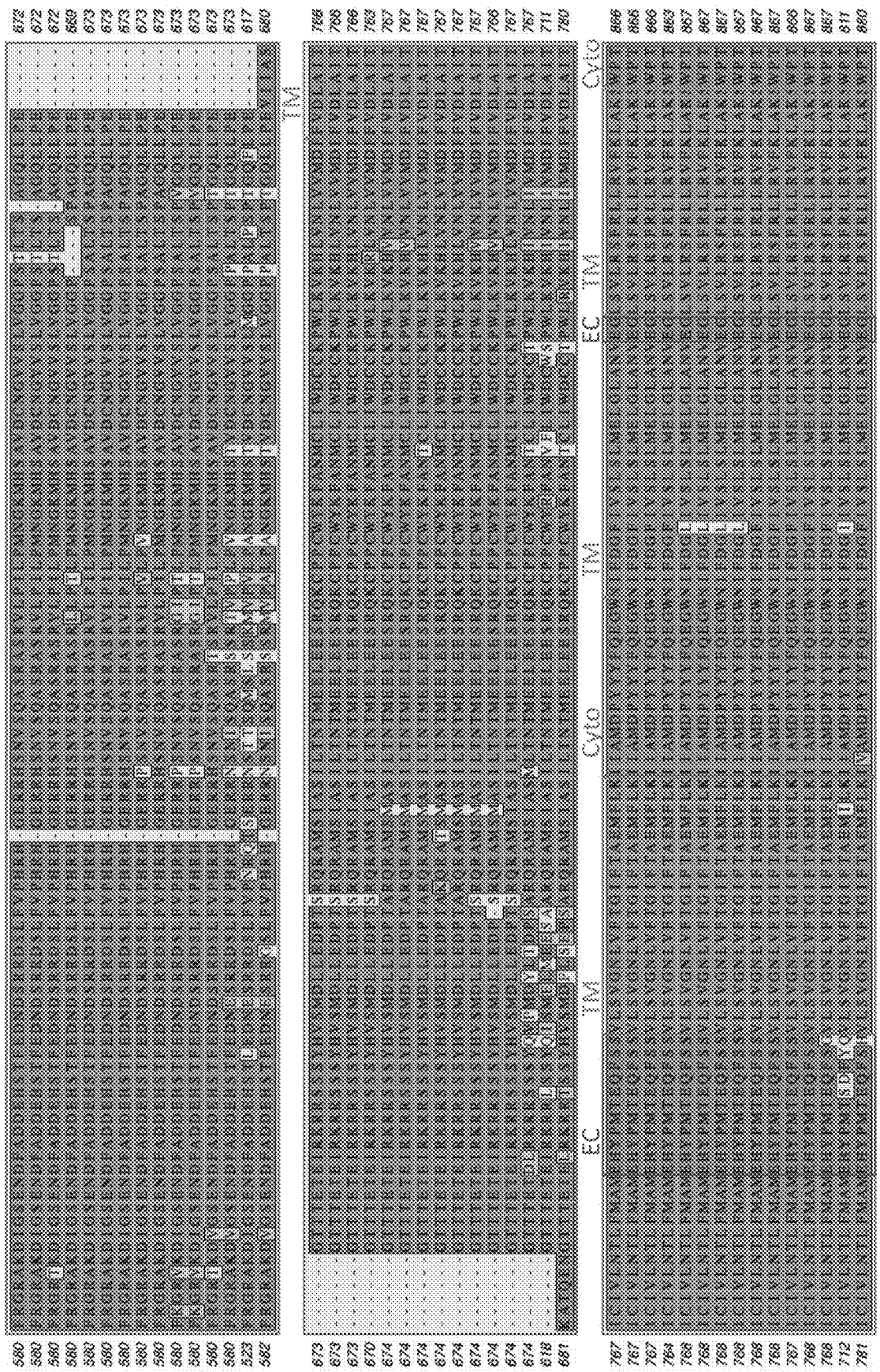
Figure 5A:
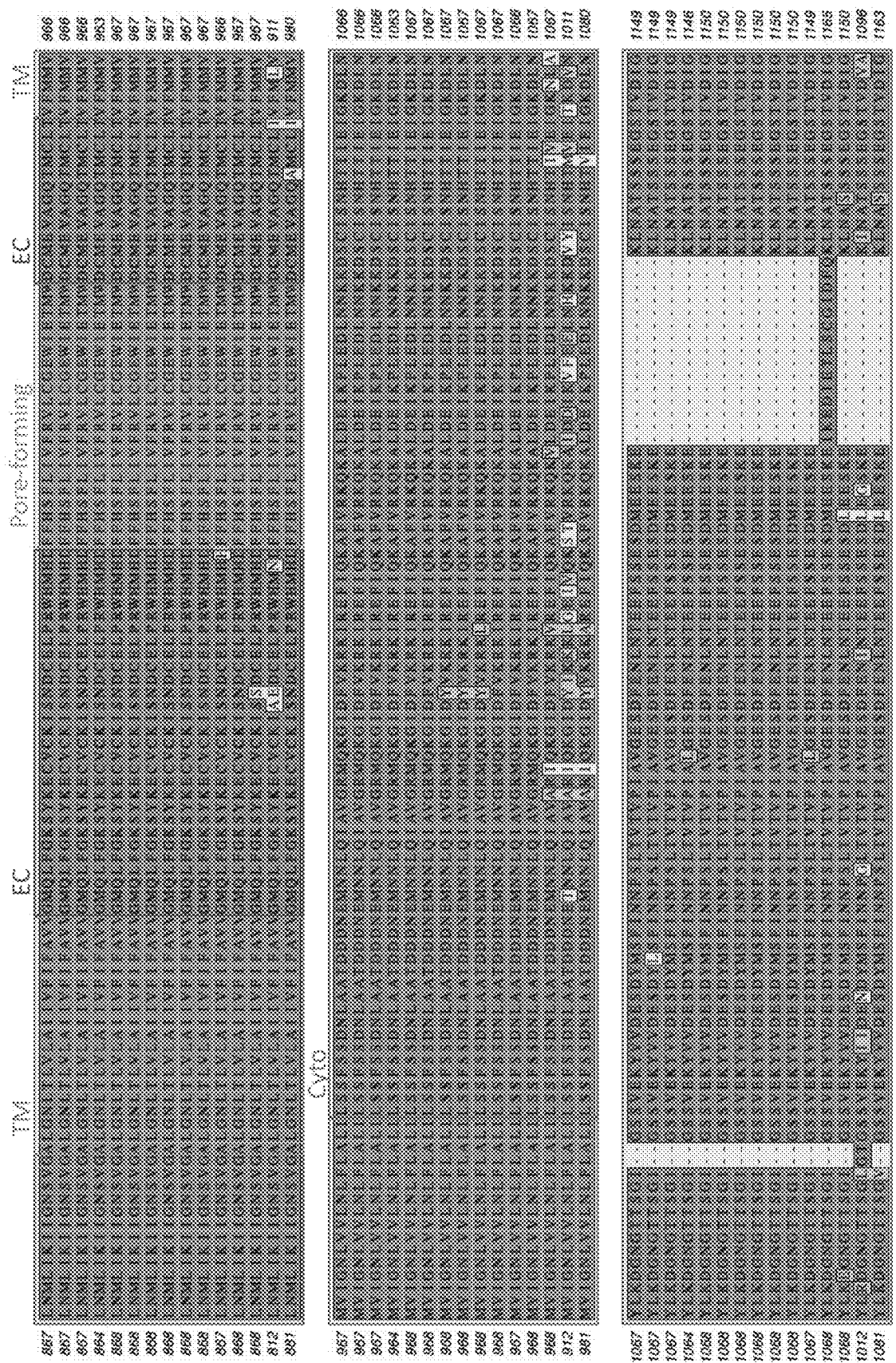
Figure 5A:
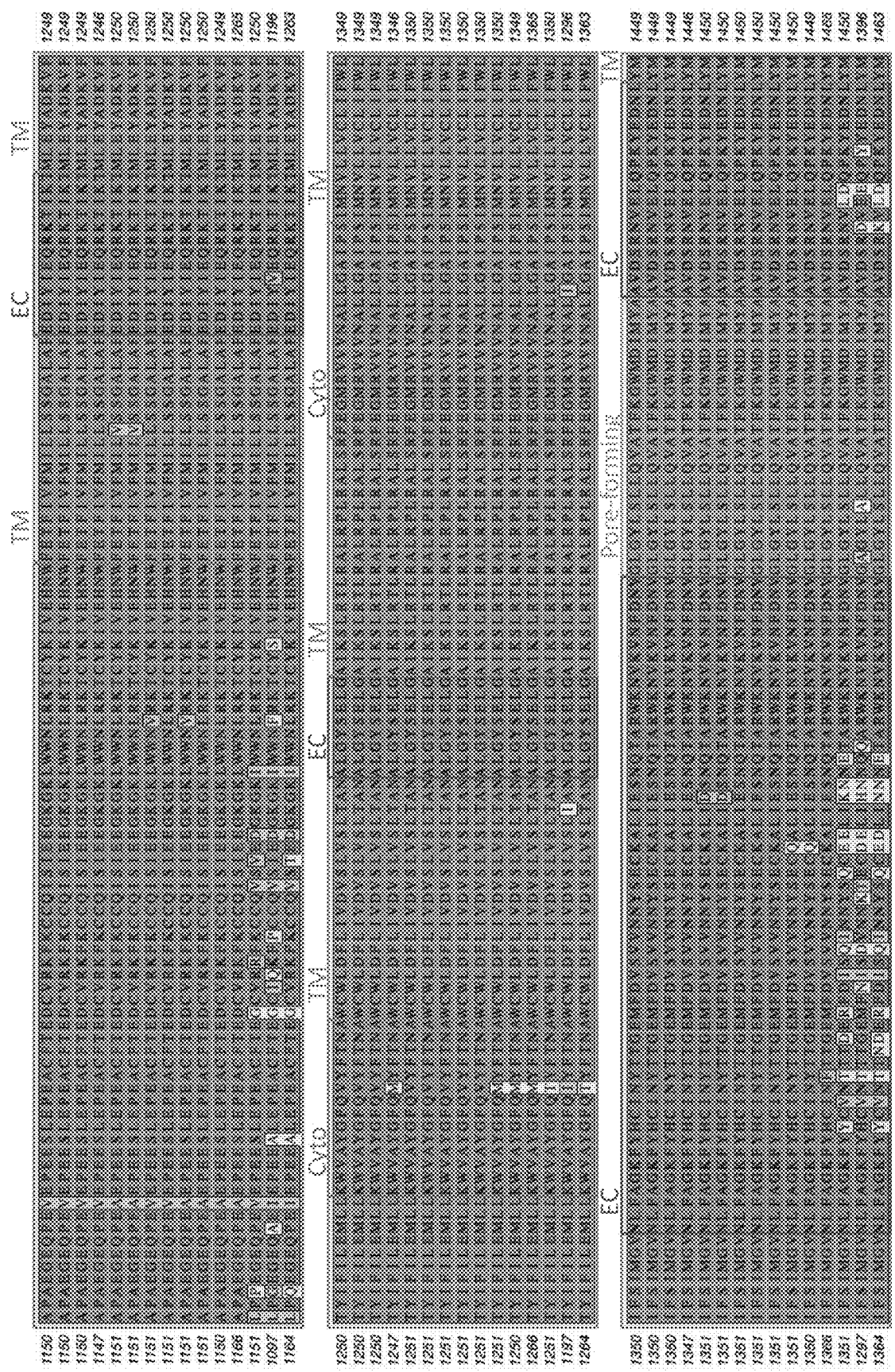
Figure 5A:
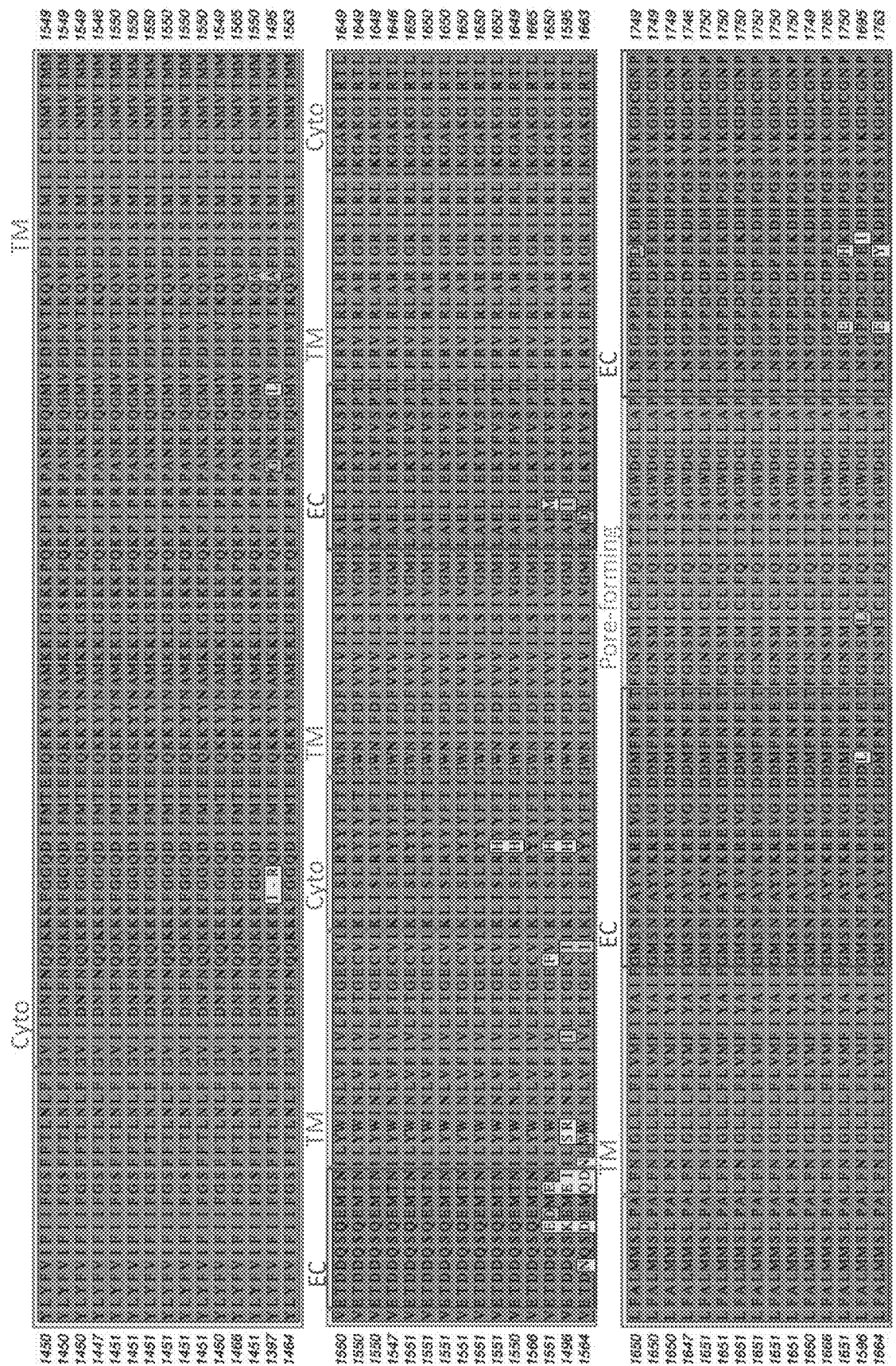
Figure 5A:
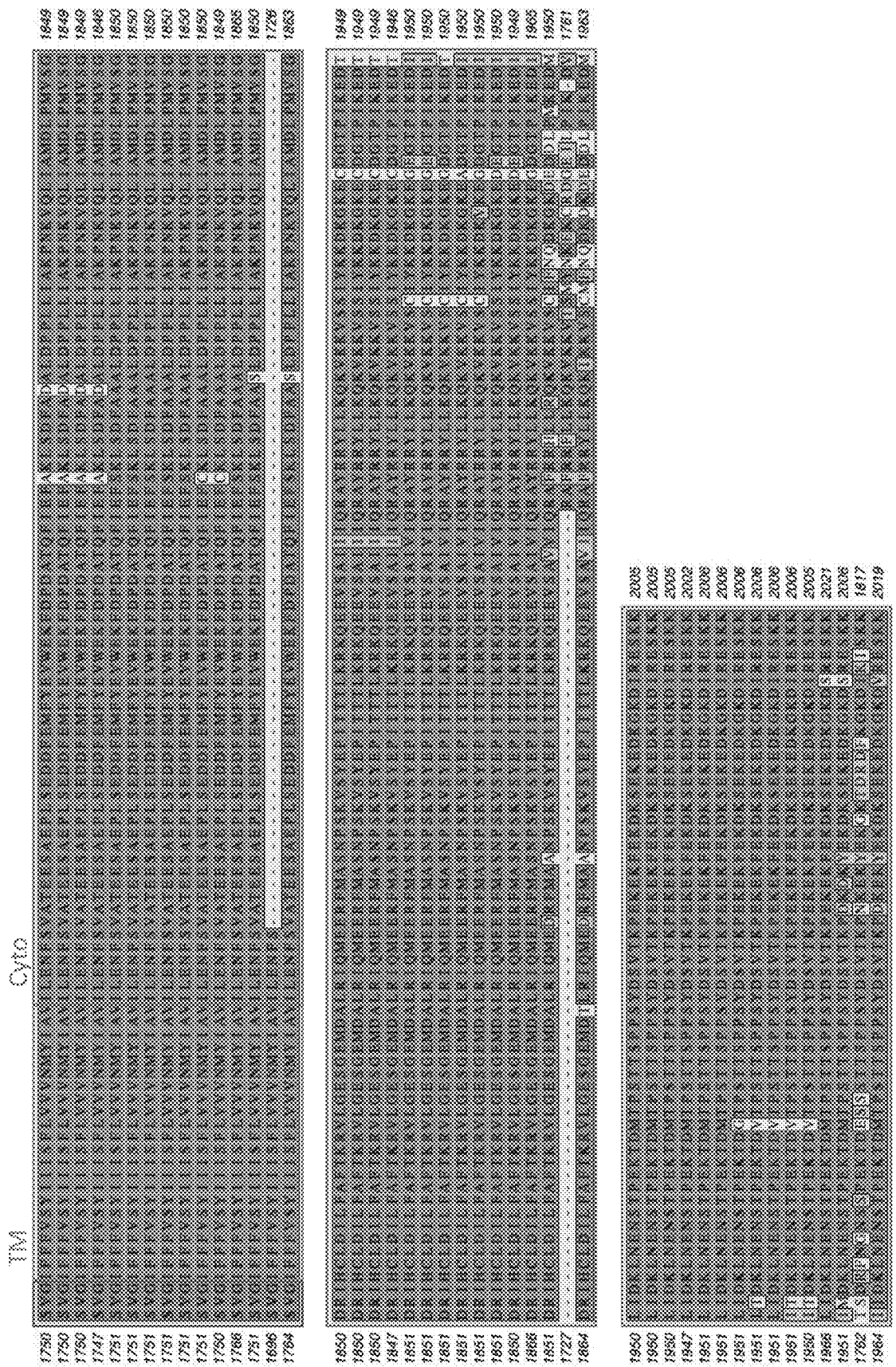
Figure 5B:
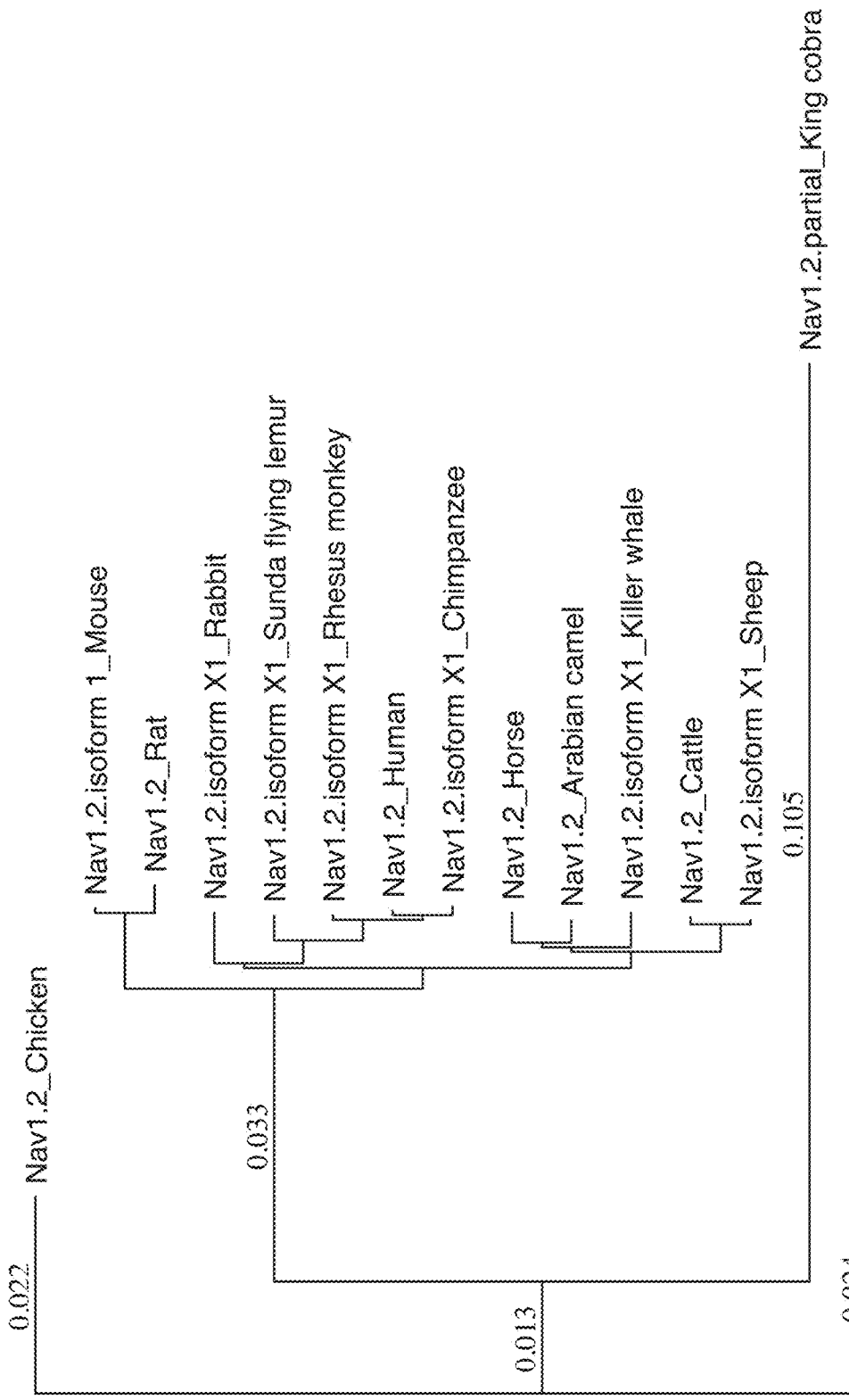
FIG. 5B. Phylogenetic tree of NaV1.2 proteins from 15 animal species.

NaV1.2 is highly conserved across species, as evident from an alignment of exemplary sequences of NaV1.2 proteins from 15 animal species provided in FIG. 5A. The accession numbers and sequence identifiers for the exemplary sequences included in the alignment are set forth below in Table 4.

TABLE 4

| Species of NaV1.2 | Accession No. | SEQ ID NO |
|---|---|---|
| Human | Q99250.3 | SEQ ID NO: 4 |
| Chimpanzee | XP_003820970.1 | SEQ ID NO: 43 |
| Rhesus monkey | XP_001100368.1 | SEQ ID NO: 44 |
| Sunda flying lemur | XP_008582720.1 | SEQ ID NO: 45 |
| Cattle | NP_001137581.1 | SEQ ID NO: 46 |
| Sheep | XP_014948870.1 | SEQ ID NO: 47 |
| Arabian camel | XP_010980763.1 | SEQ ID NO: 48 |
| Killer whale | XP_004283641.1 | SEQ ID NO: 49 |
| Horse | XP_014588001.1 | SEQ ID NO: 50 |
| Mouse | NP_001092768.1 | SEQ ID NO: 51 |
| Rat | P04775.1 | SEQ ID NO: 52 |
| Rabbit | XP_008256915.1 | SEQ ID NO: 53 |
| Chicken | NP_001280210.1 | SEQ ID NO: 54 |
| King cobra (partial sequence) | ETE69867.1 | SEQ ID NO: 55 |
| Green sea turtle | XP_007056690.1 | SEQ ID NO: 56 |

Genetically Modified Rodents

In one aspect of some embodiments, this disclosure is directed to genetically modified rodent animals wherein the genetic modification comprises an insertion of at least a portion of an exogenous Scn gene into an endogenous Scn9a locus.

In some embodiments, this disclosure provides genetically modified rodent animals whose genome comprises a nucleic acid molecule at an endogenous Scn9a locus, wherein the nucleic acid molecule encodes a NaV protein and comprises at least a portion of an exogenous Scn gene.

The term "humanized", as used herein, includes modified to include human sequences. For example, a humanized locus is a locus (e.g., an endogenous locus) that has been modified to include human sequences (e.g., gene segments or genes).

The term "germline genome", as used herein, refers to the genome found in a germ cell (e.g., a gamete, e.g., a sperm or egg) used in the formation of an animal. A germline genome is a source of genomic DNA for cells in an animal. As such, an animal (e.g., a mouse or rat) having a modification in its germline genome is considered to have the modification in the genomic DNA of all of its cells.

The term "in place of", as used herein, refers to a positional substitution in which a first nucleic acid sequence is located at the position of a second nucleic acid sequence in a chromosome (e.g., where the second nucleic acid sequence was previously (e.g., originally) located in a chromosome, e.g., at the endogenous locus of the second nucleic acid sequence). The phrase "in place of" does not require that the second nucleic acid sequence be removed from, e.g., a locus or chromosome. In some embodiments, the second nucleic acid sequence and the first nucleic acid sequence are comparable to one another in that, for example, the first and second sequences are homologous to one another, contain corresponding elements (e.g., protein-coding elements, regulatory elements, etc.), and/or have similar or identical sequences. In some embodiments, a first and/or second nucleic acid sequence includes one or more of a promoter, an enhancer, a splice donor site, a splice acceptor site, an intron, an exon, an untranslated region (UTR); in some embodiments, a first and/or second nucleic acid sequence includes one or more coding sequences. In some embodiments, a first nucleic acid sequence is a homolog or variant (e.g., mutant) of the second nucleic acid sequence. In some embodiments, a first nucleic acid sequence is an ortholog or homolog, of the second sequence. In some embodiments, a first nucleic acid sequence is or comprises a human nucleic acid sequence. In some embodiments, including where the first nucleic acid sequence is or comprises a human nucleic acid sequence, the second nucleic acid sequence is or comprises a rodent sequence (e.g., a mouse or rat sequence). In some embodiments, including where the first nucleic acid sequence is or comprises a human nucleic acid sequence, the second nucleic acid sequence is or comprises a human sequence. In some embodiments, a first nucleic acid sequence is a variant or mutant (i.e., a sequence that contains one or more sequence differences, e.g., substitutions, as compared to the second sequence) of the second sequence. The nucleic acid sequence so placed may include one or more regulatory sequences that are part of source nucleic acid sequence used to obtain the sequence so placed (e.g., promoters, enhancers, 5'- or 3'-untranslated regions, etc.). For example, in various embodiments, a first nucleic acid sequence is a substitution of an endogenous sequence with a heterologous sequence that results in the production of a gene product from the nucleic acid sequence so placed (comprising the heterologous sequence), but not expression of the endogenous sequence; a first nucleic acid sequence is of an endogenous genomic sequence with a nucleic acid sequence that encodes a polypeptide that has a similar function as a polypeptide encoded. by the endogenous sequence (e.g., the endogenous genomic sequence encodes a non-human variable region polypeptide, in whole or in part, and the DNA fragment encodes one or more human variable region polypeptides, in whole or in part). In various embodiments, a human immunoglobulin gene segment or fragment thereof is in place of an endogenous non-human immunoglobulin gene segment or fragment.

The term "NaV protein", as used herein, includes (1) naturally occurring (wild-type) voltage-gated sodium channels of the NaV family, i.e., NaV1.1, NaV1.2, NaV1.3, NaV1.4, NaV1.5, NaV1.6, NaV1.7, NaV1.8 and NaV1.9, and (2) engineered voltage-gated sodium channels. An engineered NaV protein maintains the four repeat domain structure characteristic of a naturally occurring NaV protein, with each domain containing six membrane-spanning segments, and also functions as a voltage gated sodium channel like a naturally occurring NaV protein. A non-limiting embodiment of an engineered voltage-gated sodium channel is a chimeric protein that includes the extracellular domains of a NaV1.2 protein and the transmembrane and cytoplasmic domains of a rodent NaV1.7 protein.

The term "Scn gene", as used herein, includes a nucleic acid encoding a naturally occurring NaV protein. By "exogenous Scn gene" it is meant a Scn gene not present within a rodent Scn9a locus as the locus is found in nature. In some embodiments, an exogenous Scn gene is an Scn gene that is not rodent Scn9a. In some embodiments, an Scn gene is or comprises an Scn1a, Scn2a, Scn3a, Scn4a, Scn5a, Scn8a, Scn10a, or Scn11a gene. In some embodiments, an Scn gene is from an animal species including, but not limited to, human, chimpanzee, rhesus monkey, sunda flying lemur, rabbit, horse, Arabian camel, killer whale, cattle, sheep, rat, mouse, dog, chicken, green sea turtle, or king cobra. In some embodiments, an exogenous Scn gene is an Scn9a gene from an animal species different from the rodent being modified; for example, an exogenous Scn gene at a rodent Scn9a locus could be a human, chimpanzee, rhesus monkey, sunda flying lemur, rabbit, horse, Arabian camel, killer whale, cattle, sheep, dog, chicken, green sea turtle, or king cobra Scn9a gene, or an Scn gene from a rodent species different from the rodent being genetically modified. In some embodiments, an exogenous Scn gene is a human SCN2A gene (encoding a human NaV1.2 protein).

References to "a portion" of a gene include a contiguous nucleotide sequence of at least 6, 7, 8, 9, 10, 11, 12, 13, 14, 15, 16, 17, 18, 19, 20, 21, 22, 23, 24, 25, 26, 27, 28, 29, 30 or more nucleotides of the gene, which can be nucleotides of an exon(s) or a combination of exon(s) and intron(s). A "portion" of a gene is understood to be shorter than the full length gene.

References to "a nucleic acid molecule comprising at least a portion of an exogenous Scn gene" include, e.g., references to a genomic DNA in whole or in part of an exogenous Scn gene; a nucleic acid molecule (e.g., genomic DNA or cDNA) comprising a coding sequence (from the ATG codon to the stop codon) of an exogenous Scn gene; a nucleic acid (e.g., genomic DNA or cDNA) comprising nucleotides of one or more exons of an exogenous Scn gene that encode amino acids of one or more extracellular domains of the NaV protein encoded by the exogenous Scn gene.

In some embodiments of a genetically modified rodent disclosed herein, the genome of the genetically modified rodent comprises a nucleic acid molecule at an endogenous Scn9a locus, wherein the nucleic acid molecule comprises a coding sequence of an exogenous Scn gene and encodes a protein identical to the NaV protein encoded by the exogenous Scn gene.

In some embodiments, a nucleic acid molecule at an endogenous rodent Scn9a locus comprises the coding sequence of an exogenous Scn gene selected from the group consisting of Scn1a, Scn2a, Scn3a, Scn4a, Scn5a, Scn8a, Scn10a, and Scn11a. In some embodiments, a nucleic acid molecule at an endogenous rodent Scn9a locus comprises the coding sequence of a Scn2a gene.

In some embodiments, a nucleic acid molecule at an endogenous rodent Scn9a locus comprises the coding sequence of an exogenous Scn gene from a species selected from the group consisting of human, chimpanzee, rhesus monkey, sunda flying lemur, rabbit, horse, Arabian camel, killer whale, cattle, sheep, rat, mouse, dog, chicken, green sea turtle, and king cobra.

In some embodiments, a nucleic acid molecule at an endogenous rodent Scn9a locus comprises the coding sequence of a Scn2a gene, and the Scn2a gene is from a species selected from human, chimpanzee, rhesus monkey, sunda flying lemur, rabbit, horse, Arabian camel, killer whale, cattle, sheep, rat, mouse, dog, chicken, green sea turtle, and king cobra.

In some embodiments, a nucleic acid molecule at an endogenous rodent Scn9a locus comprises the coding sequence of a human SCN2A gene. In some embodiments, the coding sequence of a human SCN2A gene is a genomic fragment that comprises the coding region (e.g., from the ATG codon to the stop codon) of a human SCN2A gene. In some embodiments, the coding sequence of a human SCN2A gene is a cDNA. In some embodiments, the coding sequence of a human SCN2A gene encodes a NaV1.2 protein comprising an amino acid sequence having at least 95%, at least 96%, at least 97%, at least 98%, or at least 99%, identity with SEQ ID NO: 4. In some embodiments, the coding sequence of a human SCN2A gene encodes a NaV1.2 protein comprising an amino acid sequence having at least 95% identity with SEQ ID NO: 4. In some embodiments, the coding sequence of a human SCN2A gene encodes a NaV1.2 protein comprising an amino acid sequence having at least 96% identity with SEQ ID NO: 4. In some embodiments, the coding sequence of a human SCN2A gene encodes a NaV1.2 protein comprising an amino acid sequence having at least 97% identity with SEQ ID NO: 4. In some embodiments, the coding sequence of a human SCN2A gene encodes a NaV1.2 protein comprising an amino acid sequence having at least 98% identity with SEQ ID NO: 4. In some embodiments, the coding sequence of a human SCN2A gene encodes a NaV1.2 protein comprising an amino acid sequence having at least 99% identity with SEQ ID NO: 4. In some embodiments, the coding sequence of a human SCN2A gene encodes a NaV1.2 protein comprising an amino acid sequence having greater than 99% identity with SEQ ID NO: 4. In some embodiments, the coding sequence of a human SCN2A gene encodes a NaV1.2 protein comprising an amino acid sequence identical to SEQ ID NO: 4.

In some embodiments of a genetically modified rodent disclosed herein, the genome of the rodent comprises a nucleic acid molecule at an endogenous Scn9a locus, wherein the nucleic acid molecule comprises a portion of an exogenous Scn gene and a portion of an endogenous Scn9a gene, and wherein the nucleic acid molecule encodes a NaV protein that comprises a part of the NaV protein encoded by the exogenous Scn gene. By a "part" of a NaV protein, it is meant to include references to a contiguous sequence of at least 2, 3, 4, 5, 6, 7, 8, 9, 10, 11, 12, 13, 14, 15, 16, 17, 18, 19, 20 or more amino acids of the NaV protein, but shorter than the full length NaV protein. In some embodiments, a part of a NaV protein comprises a contiguous sequence of at least 2 amino acids of a NaV protein. In some embodiments, a part of a NaV protein comprises a contiguous sequence of at least 3 amino acids of a NaV protein. In some embodiments, a part of a NaV protein comprises a contiguous sequence of at least 4 amino acids of a NaV protein. In some embodiments, a part of a NaV protein comprises a contiguous sequence of at least 5 amino acids of a NaV protein. In some embodiments, a part of a NaV protein comprises a contiguous sequence of at least 6 amino acids of a NaV protein. In some embodiments, a part of a NaV protein comprises a contiguous sequence of at least 7 amino acids of a NaV protein. In some embodiments, a part of a NaV protein comprises a contiguous sequence of at least 8 amino acids of a NaV protein. In some embodiments, a part of a NaV protein comprises a contiguous sequence of at least 9 amino acids of a NaV protein. In some embodiments, a part of a NaV protein comprises a contiguous sequence of at least 10 amino acids of a NaV protein. In some embodiments, a part of a NaV protein comprises a contiguous sequence of at least 11 amino acids of a NaV protein. In some embodiments, a part of a NaV protein comprises a contiguous sequence of at least 12 amino acids of a NaV protein. In some embodiments, a part of a NaV protein comprises a contiguous sequence of at least 13 amino acids of a NaV protein. In some embodiments, a part of a NaV protein comprises a contiguous sequence of at least 14 amino acids of a NaV protein. In some embodiments, a part of a NaV protein comprises a contiguous sequence of at least 15 amino acids of a NaV protein. In some embodiments, a part of a NaV protein comprises a contiguous sequence of at least 16 amino acids of a NaV protein. In some embodiments, a part of a NaV protein comprises a contiguous sequence of at least 17 amino acids of a NaV protein. In some embodiments, a part of a NaV protein comprises a contiguous sequence of at least 18 amino acids of a NaV protein. In some embodiments, a part of a NaV protein comprises a contiguous sequence of at least 19 amino acids of a NaV protein. In some embodiments, a part of a NaV protein comprises a contiguous sequence of at least 20 amino acids of a NaV protein. In some embodiments, a part of a NaV protein is a domain of the NaV protein, such as an extracellular domain, a transmembrane domain, or a cytoplasmic domain.

In some embodiments, the nucleic acid molecule comprises portions of an exogenous Scn gene that encode the extracellular domains of the NaV protein encoded by the exogenous Scn gene, such that the nucleic acid molecule at the endogenous Scn9 locus encodes a NaV protein comprising the extracellular domains of the NaV protein encoded by the exogenous Scn gene.

In some embodiments, a nucleic acid molecule at an endogenous rodent Scn9a locus comprises portions of an exogenous Scn gene that encode the extracellular domains of the NaV protein encoded by the exogenous Scn gene, wherein the exogenous Scn gene is selected from the group consisting of Scn1a, Scn2a, Scn3a, Scn4a, Scn5a, Scn8a, Scn10a, and Scn11a genes. In some embodiments, a nucleic acid molecule at an endogenous rodent Scn9a locus comprises portions of an exogenous Scn gene that encode the extracellular domains of the NaV protein encoded by the exogenous Scn gene, wherein the exogenous Scn gene is a Scn1a gene. In some embodiments, a nucleic acid molecule at an endogenous rodent Scn9a locus comprises portions of an exogenous Scn gene that encode the extracellular domains of the NaV protein encoded by the exogenous Scn gene, wherein the exogenous Scn gene is a Scn2a gene. In some embodiments, a nucleic acid molecule at an endogenous rodent Scn9a locus comprises portions of an exogenous Scn gene that encode the extracellular domains of the NaV protein encoded by the exogenous Scn gene, wherein the exogenous Scn gene is a Scn3a gene. In some embodiments, a nucleic acid molecule at an endogenous rodent Scn9a locus comprises portions of an exogenous Scn gene that encode the extracellular domains of the NaV protein encoded by the exogenous Scn gene, wherein the exogenous Scn gene is a Scn5a gene. In some embodiments, a nucleic acid molecule at an endogenous rodent Scn9a locus comprises portions of an exogenous Scn gene that encode the extracellular domains of the NaV protein encoded by the exogenous Scn gene, wherein the exogenous Scn gene is a Scn8a gene. In some embodiments, a nucleic acid molecule at an endogenous rodent Scn9a locus comprises portions of an exogenous Scn gene that encode the extracellular domains of the NaV protein encoded by the exogenous Scn gene, wherein the exogenous Scn gene is a Scn10a gene. In some embodiments, a nucleic acid molecule at an endogenous rodent Scn9a locus comprises portions of an exogenous Scn gene that encode the extracellular domains of the NaV protein encoded by the exogenous Scn gene, wherein the exogenous Scn gene is a Scn11a gene. In some embodiments, a nucleic acid molecule at an endogenous rodent Scn9a locus comprises portions of a Scn2a gene that encode the extracellular domains of the NaV1.2 protein encoded by the exogenous Scn2a gene.

In some embodiments, a nucleic acid molecule at an endogenous rodent Scn9a locus comprises portions of an exogenous Scn gene from a species different from the rodent species being modified, including but not limited to human, chimpanzee, rhesus monkey, sunda flying lemur, rabbit, horse, Arabian camel, killer whale, cattle, sheep, rat, mouse, dog, chicken, green sea turtle, and king cobra.

In some embodiments, a nucleic acid molecule at an endogenous rodent Scn9a locus comprises portions of an exogenous Scn2a gene that encode the extracellular domains of the NaV1.2 protein encoded by the exogenous Scn2a gene, wherein the exogenous Scn2a gene is from a species selected from human, chimpanzee, rhesus monkey, sunda flying lemur, rabbit, horse, Arabian camel, killer whale, cattle, sheep, rat, mouse, dog, chicken, green sea turtle, and king cobra. In some embodiments, the exogenous Scn2a gene is a human SCN2A gene, and the nucleic acid molecule at an endogenous rodent Scn9a locus comprises portions of a human SCN2A gene that encode the extracellular domains of a human Nav1.2 protein. In some embodiments, the human NaV1.2 protein comprises an amino acid sequence having at least 95%, at least 96%, at least 97%, at least 98%, at least 99%, or greater than 99% identity with SEQ ID NO: 4. In some embodiments, the human NaV1.2 protein comprises an amino acid sequence having at least 95% identity with SEQ ID NO: 4. In some embodiments, the human NaV1.2 protein comprises an amino acid sequence having at least 96% identity with SEQ ID NO: 4. In some embodiments, the human NaV1.2 protein comprises an amino acid sequence having at least 97% identity with SEQ ID NO: 4. In some embodiments, the human NaV1.2 protein comprises an amino acid sequence having at least 98% identity with SEQ ID NO: 4. In some embodiments, the human NaV1.2 protein comprises an amino acid sequence having at least 99% identity with SEQ ID NO: 4. In some embodiments, the human NaV1.2 protein comprises an amino acid sequence having greater than 99% identity with SEQ ID NO: 4. In specific embodiments, a human SCN2A gene encodes a NaV1.2 protein comprising an amino acid sequence identical to SEQ ID NO: 4. The extracellular domains of the human NaV1.2 protein of SEQ ID NO: 4 are depicted in FIG. 1D (the junctions between an extracellular domain and a transmembrane or cytoplasmic domain can be shifted by 1-2 amino acids from those depicted in FIG. 1D).

In some embodiments, in addition to portions of an exogenous Scn gene that encode extracellular domains, the nucleic acid molecule at an endogenous rodent Scn9a locus also comprises portions of the endogenous rodent Scn9a gene that encode the transmembrane and cytoplasmic domains of the endogenous rodent NaV1.7 protein. In some embodiments, the rodent animal is a mouse, and the nucleic acid molecule at an endogenous mouse Scn9a locus comprises portions of the endogenous mouse Scn9a gene that encode the transmembrane and cytoplasmic domains of the endogenous mouse NaV1.7 protein. In some embodiments, an endogenous mouse Scn9a gene encodes a mouse NaV1.7 protein having at least 95%, at least 96%, at least 97%, at least 98%, at least 99%, or greater than 99% identity with SEQ ID NO: 2, In some embodiments, an endogenous mouse Scn9a gene encodes a mouse NaV1.7 protein having at least 95% identity with SEQ ID NO: 2. In some embodiments, an endogenous mouse Scn9a gene encodes a mouse NaV1.7 protein having at least 96% identity with SEQ ID NO: 2. In some embodiments, an endogenous mouse Scn9a gene encodes a mouse NaV1.7 protein having at least 97% identity with SEQ ID NO: 2. In some embodiments, an endogenous mouse Scn9a gene encodes a mouse NaV1.7 protein having at least 98% identity with SEQ ID NO: 2. In some embodiments, an endogenous mouse Scn9a gene encodes a mouse NaV1.7 protein having at least 99% identity with SEQ ID NO: 2. In some embodiments, an endogenous mouse Scn9a gene encodes a mouse NaV1.7 protein having greater than 99% identity with SEQ ID NO: 2. In a specific embodiment, an endogenous mouse NaV1.7 protein comprises an amino acid sequence identical to SEQ ID NO: 2. The transmembrane and cytoplasmic domains of the mouse NaV1.7 protein of SEQ ID NO: 2 are depicted in FIG. 1D (the junctions between an extracellular domain and a transmembrane or cytoplasmic domain can be shifted by 1-2 amino acids from those depicted in FIG. 1D).

In some embodiments, the rodent animal is a rat, and the nucleic acid molecule at an endogenous rat Scn9a locus comprises portions of the endogenous rat Scn9a gene that encode the transmembrane and cytoplasmic domains of the endogenous rat NaV1.7 protein. In some embodiments, an endogenous rat Scn9a gene encodes a rat NaV1.7 protein having at least 95%, at least 96%, at least 97%, at least 98%, at least 99%, or greater than 99% identity with SEQ ID NO: 39, In some embodiments, an endogenous rat Scn9a gene encodes a rat NaV1.7 protein having at least 95% identity with SEQ ID NO: 39. In some embodiments, an endogenous rat Scn9a gene encodes a rat NaV1.7 protein having at least 96% identity with SEQ ID NO: 39. In some embodiments, an endogenous rat Scn9a gene encodes a rat NaV1.7 protein having at least 97% identity with SEQ ID NO: 39. In some embodiments, an endogenous rat Scn9a gene encodes a rat NaV1.7 protein having at least 98% identity with SEQ ID NO: 39. In some embodiments, an endogenous rat Scn9a gene encodes a rat NaV1.7 protein having at least 99% identity with SEQ ID NO: 39. In some embodiments, an endogenous rat Scn9a gene encodes a rat NaV1.7 protein having greater than 99% identity with SEQ ID NO: 39. In some embodiments, an endogenous rat NaV1.7 protein comprises an amino acid sequence identical to SEQ ID NO: 39.

In some embodiments of a genetically modified rodent animal disclosed herein, the nucleic acid molecule present at an endogenous Scn9a locus that encodes a NaV protein and comprises at least a portion of an exogenous Scn gene is a cDNA molecule. In some embodiments, the nucleic acid molecule present at an endogenous Scn9a locus that encodes a NaV protein and comprises at least a portion of an exogenous Scn gene is a genomic DNA.

In some embodiments, the nucleic acid present at an endogenous Scn9a locus, which encodes a NaV protein and comprises at least a portion of an exogenous Scn gene, may result from a genetic modification where the endogenous Scn9a gene at the endogenous rodent Scn9a locus has been replaced in full or in part with an exogenous Scn gene in full or in part. In some embodiments, a genomic fragment comprising the coding sequence (e.g., from the ATG codon to the stop codon) of an endogenous rodent Scn9a gene has been replaced by the coding sequence (e.g., from the ATG codon to the stop codon, in genomic DNA or cDNA) of an exogenous Scn gene; and in some embodiments, the exogenous Scn gene is an Scn2a gene, e.g., an Scn2a gene from human, chimpanzee, rhesus monkey, sunda flying lemur, rabbit, horse, Arabian camel, killer whale, cattle, sheep, rat, mouse, dog, chicken, green sea turtle, or king cobra. In some embodiments, the exogenous Scn gene is a human SCN2A gene. In some embodiments, portions of an endogenous rodent Scn9a gene that encode one or more or all of the extracellular domains of the endogenous rodent NaV1.7 protein have been replaced by portions of an exogenous Scn gene that encode the corresponding extracellular domains of the NaV protein encoded by the exogenous Scn gene. In some embodiments, exogenous Scn genes suitable for replacement of an endogenous rodent Scn9a gene include any of those described hereinabove, e.g., an Scn1a, Scn2a, Scn3a, Scn4a, Scn5a, Scn 8a, Scn10a, or Scn11a gene, or an Scn9a gene from an animal species different from the rodent being modified; and in some embodiments, the exogenous Scn gene is an Scn2a gene, e.g., an Scn2a gene from human, chimpanzee, rhesus monkey, sunda flying lemur, rabbit, horse, Arabian camel, killer whale, cattle, sheep, rat, mouse, dog, chicken, green sea turtle, or king cobra. In some embodiments, the exogenous Scn gene is a human SCN2A gene.

In some embodiments, a nucleic acid molecule at an endogenous Scn9a locus, which encodes a NaV protein and comprises at least a portion of an exogenous Scn gene, is operably linked to 5' transcriptional regulatory sequences (e.g., promoter and/or enhancer). In some embodiments, a nucleic acid molecule at an endogenous Scn9a locus, which encodes a NaV protein and comprises at least a portion of an exogenous Scn gene, is operably linked to the 5' untranslated region (5' UTR) of the endogenous Scn9a gene. In some embodiments, the nucleic acid molecule is operably linked to the 5' untranslated region (5' UTR) of the exogenous Scn gene. In some embodiments, a nucleic acid molecule at an endogenous Scn9a locus, which encodes a NaV protein and comprises at least a portion of an exogenous rodent Scn gene, is operably linked to both the 5' UTR and the 5' transcriptional regulatory sequences (e.g., the promoter and/or enhancer) of the endogenous Scn9a gene.

In some embodiments, a nucleic acid molecule at an endogenous Scn9a locus, which encodes a NaV protein and comprises at least a portion of an exogenous Scn gene, is operably linked to 3' regulatory sequences, e.g., the 3' UTR, of the endogenous Scn9a gene. In some embodiments, the nucleic acid molecule at an endogenous Scn9a locus, which encodes a NaV protein and comprises at least a portion of an exogenous Scn gene, comprises the 3' UTR of the exogenous Scn gene. In some embodiments, the nucleic acid molecule comprises the 3' UTR of the exogenous Scn gene and an additional genomic sequence of the exogenous Scn gene beyond the 3' UTR, e.g., a genomic sequence of 30-500 bp or more, found in an exogenous Scn gene locus immediately downstream of the 3' UTR of the exogenous Scn gene.

In some embodiments, a genetically modified rodent is heterologous with respect to the genetic modification, i.e., heterologous with respect to the nucleic acid molecule at an endogenous Scn9a locus that comprises at least a portion of an exogenous Scn gene. In some embodiments, a genetically modified rodent is homozygous with respect to the genetic modification, i.e., homozygous with respect to the nucleic acid molecule at an endogenous Scn9a locus that comprises at least a portion of an exogenous Scn gene.

In some embodiments, a genetically modified rodent disclosed herein is incapable of expressing an endogenous rodent NaV1.7 protein, e.g., as a result of the genetic modification to the endogenous rodent Scn9a locus or an inactivation (e.g., deletion in full or in part) of the endogenous rodent Scn9a gene.

In some embodiments, a genetically modified rodent (e.g., rat or mouse) as described herein comprises in their genome (e.g., via cross-breeding or multiple gene targeting strategies) (i) a humanized immunoglobulin heavy chain locus comprising one or more human $V_H$ gene segments, one or more human $D_H$ gene segments, and one or more human $J_H$ gene segments that are upstream of (e.g., operably linked to) one or more rodent (e.g., rat or mouse) immunoglobulin heavy chain constant region genes (e.g., one or more endogenous rodent (e.g., rat or mouse) immunoglobulin heavy chain constant region genes). Such a humanized immunoglobulin heavy chain locus is referred to herein as a "humanized HoH locus." In some embodiments, a genetically modified rodent (e.g., rat or mouse) is homozygous at a humanized HoH locus. In some embodiments, a genetically modified rodent (e.g., rat or mouse) is heterozygous at a humanized HoH locus.

In some embodiments, a genetically modified rodent (e.g., rat or mouse), which comprises a humanized HoH locus, produces an antibody comprising, inter alia, heavy chains, where each heavy chain comprises a human heavy chain variable domain operably linked to a rodent (e.g., rat or mouse) heavy chain constant domain, e.g., in response to antigenic stimulation.

In some embodiments, a genetically modified rodent (e.g., rat or mouse) comprises in its genome (e.g., its germline genome) a humanized immunoglobulin heavy chain locus comprising one or more human $V_L$ gene segments and one or more human $J_L$ gene segments that are upstream of (e.g., operably linked to) one or more rodent (e.g., rat or mouse) immunoglobulin heavy chain constant region genes (e.g., one or more endogenous rodent (e.g., rat or mouse) immunoglobulin heavy chain constant region genes). Such a humanized immunoglobulin heavy chain locus is referred to herein as a "humanized LoH locus." In some embodiments, a genetically modified rodent (e.g., rat or mouse) is homozygous at a humanized LoH locus. In some embodiments, a genetically modified rodent (e.g., rat or mouse) is heterozygous at a humanized LoH locus.

In some embodiments, a genetically modified rodent (e.g., rat or mouse), which comprises a humanized LoH locus, produces an antibody comprising, inter alia, immunoglobulin chains, where each immunoglobulin chain comprises a human light chain variable domain operably linked to a rodent (e.g., rat or mouse) heavy chain constant domain, e.g., in response to antigenic stimulation.

In some embodiments, a genetically modified rodent (e.g., rat or mouse) comprises in its genome (e.g., its germline genome) a humanized immunoglobulin light chain locus (e.g., κ and/or λ) comprising one or more human $V_L$ gene segments and one or more human $J_L$ gene segments that are upstream of (e.g., operably linked to) one or more immunoglobulin light chain constant region genes. In some embodiments, one or more human $V_L$ gene segments and one or more human $J_L$ gene segments are one or more human Vκ gene segments and one or more human Jκ gene segments. In some embodiments, one or more human $V_L$ gene segments and one or more human $J_L$ gene segments are one or more human Vλ gene segments and one or more human Jλ gene segments. In some embodiments, one or more immunoglobulin light chain constant region genes is or comprises a Cκ. In some embodiments, one or more immunoglobulin light chain constant region genes is or comprises a Cλ.

In some embodiments, a genetically modified rodent (e.g., rat or mouse) comprises in its genome (e.g., its germline genome) a humanized immunoglobulin light chain locus comprising one or more human Vκ gene segments and one or more human Jκ gene segments that are upstream of (e.g., operably linked to) a Cκ gene. Such a humanized immunoglobulin heavy chain locus is referred to herein as a "humanized KoK locus." In some embodiments, an immunoglobulin κ light chain constant region gene of a humanized KoK locus is a rodent (e.g., rat or mouse) Cκ gene. In some embodiments, an immunoglobulin κ light chain constant region gene of a humanized KoK locus is an endogenous rodent (e.g., rat or mouse) Cκ gene. In some embodiments, an immunoglobulin κ light chain constant region gene of a humanized KoK locus is an endogenous rodent (e.g., rat or mouse) Cκ gene at an endogenous immunoglobulin κ light chain locus. In some embodiments, a genetically modified rodent (e.g., rat or mouse) is homozygous at a humanized KoK locus. In some embodiments, a genetically modified rodent (e.g., rat or mouse) is heterozygous at a humanized KoK locus.

In some embodiments, a genetically modified rodent (e.g., rat or mouse), which comprises a humanized KoK locus, produces an antibody comprising, inter alia, κ light chains, where each κ light chain comprises a human κ light chain variable domain operably linked to a rodent (e.g., rat or mouse) κ light chain constant domain, e.g., in response to antigenic stimulation.

In some embodiments, a genetically modified rodent (e.g., rat or mouse) comprises in its genome (e.g., its germline genome) a humanized immunoglobulin light chain locus comprising one or more human Vλ gene segments upstream of (e.g., operably linked to) one or more human Jλ gene segments and one or more Cλ genes. Such a humanized immunoglobulin light chain locus is referred to herein as a "humanized LoL locus." In some embodiments, the one or more human Jλ gene segments and one or more Cλ genes of a humanized LoL locus are present in Jλ-Cλ clusters. In some embodiments, one or more Cλ genes of a humanized LoL locus comprise one or more human Cλ genes. In some embodiments, one or more Cλ genes of a humanized LoL locus comprise one or more mouse Cλ genes. In some embodiments, one or more Cλ genes of a humanized LoL locus comprise one or more human Cλ genes and one or more mouse Cλ genes. In some embodiments, one or more mouse Cλ genes of a humanized LoL locus comprise a mouse Cλ1 gene. In some embodiments, a genetically modified rodent (e.g., rat or mouse) is homozygous at a humanized LoL locus. In some embodiments, a genetically modified rodent (e.g., rat or mouse) is heterozygous at a humanized LoL locus.

In some embodiments, a genetically modified rodent (e.g., rat or mouse), which comprises a humanized LoL locus, produces an antibody comprising, inter alia, λ light chains, where each λ light chain comprises a human λ light chain variable domain operably linked to a rodent (e.g., rat or mouse) λ light chain constant domain, e.g., in response to antigenic stimulation. In some embodiments, a genetically modified rodent (e.g., rat or mouse), which comprises a humanized LoL locus, produces an antibody comprising, inter alia, λ light chains, where each λ light chain comprises a human λ light chain variable domain operably linked to a human λ light chain constant domain, e.g., in response to antigenic stimulation.

In some embodiments, a genetically modified rodent (e.g., rat or mouse) comprises in its genome (e.g., its germline genome) a humanized immunoglobulin light chain locus comprising one or more human Vλ gene segments and one or more human Jλ gene segments upstream of (e.g., operably linked to) a Cκ gene. Such a humanized immunoglobulin light chain locus is referred to herein as a "humanized LoK locus." In some embodiments, a Cκ gene of a humanized LoK locus is a rodent (e.g., rat or mouse) Cκ gene. In some embodiments, a Cκ gene of a humanized LoK locus is an endogenous rodent (e.g., rat or mouse) Cκ gene. In some embodiments, a Cκ gene of a humanized LoK locus is an endogenous rodent (e.g., rat or mouse) Cκ gene at an endogenous immunoglobulin κ light chain locus. In some embodiments, a genetically modified rodent (e.g., rat or mouse) is homozygous at a humanized LoK locus. In some embodiments, a genetically modified rodent (e.g., rat or mouse) is heterozygous at a humanized LoK locus.

In some embodiments, a genetically modified rodent (e.g., rat or mouse), which comprises a humanized LoK locus, produces an antibody comprising, inter alia, light chains, where each light chain comprises a human λ light chain variable domain operably linked to a rodent (e.g., rat or mouse) κ light chain constant domain, e.g., in response to antigenic stimulation.

In some embodiments, a genetically modified rodent (e.g., rat or mouse) comprises in its genome (e.g., its germline genome) a humanized immunoglobulin κ light chain locus comprising one or more human Vλ gene segments and one or more human Jλ gene segments upstream of (e.g., operably linked to) a Cλ gene. Such a humanized immunoglobulin light chain locus is referred to herein as a "humanized LiK locus." In some embodiments, a Cλ gene of a humanized LiK locus is a rodent (e.g., rat or mouse) Cλ gene. In some embodiments, a Cλ gene of a humanized LiK locus is a mouse Cλ1 gene. In some embodiments, a genetically modified rodent (e.g., rat or mouse) is homozygous at a humanized LiK locus. In some embodiments, a genetically modified rodent (e.g., rat or mouse) is heterozygous at a humanized LiK locus.

In some embodiments, a genetically modified rodent (e.g., rat or mouse), which comprises a humanized LiK locus, produces an antibody comprising, inter alia, λ light chains, where each λ light chain comprises a human λ light chain variable domain operably linked to a rodent (e.g., rat or mouse) λ light chain constant domain, e.g., in response to antigenic stimulation.

In some embodiments, a genetically modified rodent (e.g., rat or mouse) comprises in its genome (e.g., its germline genome) a humanized immunoglobulin κ light chain locus comprising one or more human Vλ gene segments upstream of (e.g., operably linked to) one or more human Jλ gene segments and one or more human Cλ genes. In some embodiments, the one or more human Jλ gene segments and one or more Cλ genes of such a humanized immunoglobulin κ light chain locus are present in Jλ-Cλ clusters. In some embodiments, a genetically modified rodent (e.g., rat or mouse) is homozygous for such a humanized immunoglobulin κ light chain locus. In some embodiments, a genetically modified rodent (e.g., rat or mouse) is heterozygous for such a humanized immunoglobulin κ light chain locus. In some embodiments, a genetically modified rodent (e.g., rat or mouse), which comprises such a humanized immunoglobulin κ light chain locus, produces an antibody comprising, inter alia, λ light chains, where each λ light chain comprises a human λ light chain variable domain operably linked to a human λ light chain constant domain, e.g., in response to antigenic stimulation.

In some embodiments, a genetically modified rodent rat or mouse) comprises in its genome (e.g., its germline genome) a humanized HoH locus and a humanized KoK locus. In some embodiments, a genetically modified rodent (e.g., rat or mouse) comprises in its genome (e.g., its germline genome) a humanized HoH locus and a humanized LoL locus. In some embodiments, a genetically modified rodent (e.g., rat or mouse) comprises in its genome (e.g., its germline genome) a humanized HoH locus, a humanized KoK locus, and a humanized LoL locus. In some embodiments, a genetically modified rodent (e.g., rat or mouse) is homozygous at a humanized HoH locus, a humanized KoK locus, a humanized LoL locus, or a combination thereof.

In some embodiments, a genetically modified rodent (e.g., rat or mouse) comprises in its genome (e.g., its germline genome) a humanized HoH locus, a humanized KoK locus, and a humanized LoK locus. In some embodiments, a genetically modified rodent (e.g., rat or mouse) comprises in its genome (e.g., its germline genome) a humanized HoH locus, a humanized KoK locus, and a humanized LiK locus.

In some embodiments, a genetically modified rodent (e.g., rat or mouse) comprises in its genome (e.g., its germline genome) a humanized HoH locus and a humanized LoK locus. In some embodiments, a genetically modified rodent (e.g., rat or mouse) is homozygous at a humanized HoH locus, a humanized LoK locus, or a combination thereof.

In some embodiments, a genetically modified rodent (e.g., rat or mouse) comprises in its genome (e.g., its germline genome) a humanized HoH locus and a humanized LiK locus. In some embodiments, a genetically modified rodent (e.g., rat or mouse) is homozygous at a humanized HoH locus, a humanized LiK locus, or a combination thereof.

In some embodiments, a genetically modified rodent (e.g., rat or mouse) comprises in its genome (e.g., its germline genome) a humanized LoH locus and a humanized KoK locus. In some embodiments, a genetically modified rodent (e.g., rat or mouse) comprises in its genome (e.g., its germline genome) a humanized LoH locus and a humanized LoL locus. In some embodiments, a genetically modified rodent (e.g., rat or mouse) comprises in its genome (e.g., its germline genome) a humanized LoH locus, a humanized KoK locus, and a humanized LoL locus. In some embodiments, a genetically modified rodent (e.g., rat or mouse) is homozygous at a humanized LoH locus, a humanized KoK locus, a humanized LoL locus, or a combination thereof.

In some embodiments, a genetically modified rodent (e.g., rat or mouse) comprises in its genome (e.g., its germline genome) a humanized LOH locus, a humanized KoK locus, and a humanized LoK locus. In some embodiments, a genetically modified rodent (e.g., rat or mouse) comprises in its genome (e.g., its germline genome) a humanized LoH locus, a humanized KoK locus, and a humanized LiK locus.

In some embodiments, a genetically modified rodent (e.g., rat or mouse) comprises in its genome (e.g., its germline genome) a humanized LoH locus and a humanized LoK locus. In some embodiments, a genetically modified rodent (e.g., rat or mouse) is homozygous at a humanized LoH locus, a humanized LoK locus, or a combination thereof.

In some embodiments, a genetically modified rodent (e.g., rat or mouse) comprises in its genome (e.g., its germline genome) a humanized LoH locus and a humanized LiK locus. In some embodiments, a genetically modified rodent (e.g., rat or mouse) is homozygous at a humanized LoH locus, a humanized LiK locus, or a combination thereof.

In some embodiments, a rodent (e.g., rat or mouse) described herein is as described in e.g., U.S. Pat. Nos. 8,502,018, 8,642,835, 8,697,940, 8,791,323, 9,226,484, and WO2019/113065; all of which are incorporated herein by reference in their entireties. Breeding (or "cross", or "crossbreeding") can be done following protocols readily available in the art; see, e.g., JoVE Science Education Database. *Lab Animal Research, Fundamentals of Breeding and Weaning*, JoVE, Cambridge, Mass., (2018) (video article); *Breeding Strategies for Maintaining Colonies of Laboratory Mice, A Jackson Laboratory Resource Manual*, ©2007 The Jackson Laboratory; all incorporated herein by reference. Alternatively, an engineered Igλ light chain locus can be engineered into an ES cell comprising a humanized IgH locus and/or a humanized Igκ locus, and the resulting ES cell is used to generate a rodent animal, or a rodent animal comprising a humanized Igλ light chain locus may be bred with another rodent animal comprising a humanized IgH locus and/or a humanized Igκ locus. Various rodent animals comprising a humanized IgH locus and/or a humanized Igκ locus are known, e.g., a VELOCIMMUNE® strain (see, e.g., U.S. Pat. Nos. 8,502,018 and/or 8,642,835; incorporated herein by reference in their entireties), a XENOMOUSE™ strain (see, e.g., Mendez, M. J. et al., 1997, Nat. Genetics 15(2): 146-56 and Jakobovits, A. et al., 1995, Ann. N.Y. Acad. Sci. 764:525-35, incorporated by reference in their entireties).

In some embodiments, rodent animals described herein comprise a limited immunoglobulin light chain locus as described in U.S. Pat. Nos. 9,796,788; 9,969,814; U.S. Patent Application Publication Nos. 2011/0195454 A1, 2012/0021409 A1, 2012/0192300 A1, 2013/0045492 A1, 2013/0185821 A1, 2013/0302836 A1; International Patent Application Publication Nos. WO2011/097603, WO2012/148873, WO2013/134263, WO2013/184761, WO 2014/160179, WO 2014/160202; each of which are hereby incorporated by reference in their entireties. In some embodiments, rodent animals described herein comprise an immunoglobulin light chain locus as described in WO2019/113065, WO2017214089, US20180125043 and U.S. Pat. Nos. 9,035,128; 9,066,502; 9,163,092; 9,150,662; 9,334,333; 9,006,511; 9,029,628; 9,206,261; 9,012,717; 9,394,373; 9,206,262; 9,206,263; 9,226,484; 9,540,452; and 9,399,683.

In some embodiments, a genetically modified rodent (e.g., rat or mouse) as provided herein has a genome (e.g., a germline genome) comprising a humanized immunoglobulin heavy chain (e.g., HoH or LoH) locus lacking a functional endogenous rodent Adam6 gene. In some embodiments, a genetically modified rodent (e.g., rat or mouse) as provided herein has a genome (e.g., a germline genome) comprising one or more nucleotide sequences encoding one or more rodent ADAM6 polypeptides, functional orthologs, functional homologs, or functional fragments thereof. In some embodiments, a genetically modified rodent (e.g., rat or mouse) as provided expresses one or more rodent (e.g., rat or mouse) ADAM6 polypeptides, functional orthologs, functional homologs, or functional fragments thereof. In some embodiments, a genetically modified rodent (e.g., rat or mouse) as provided has a genome (e.g., a germline genome) comprising one or more nucleotide sequences encoding one or more rodent (e.g., rat or mouse) ADAM6 polypeptides, functional orthologs, functional homologs, or functional fragments thereof that are included on the same chromosome as a humanized immunoglobulin heavy chain (e.g., HoH or LoH) locus. In some embodiments, a genetically modified rodent (e.g., rat or mouse) as provided has a genome (e.g., a germline genome) comprising a humanized immunoglobulin heavy chain (e.g., HoH or LoH) locus comprising one or more nucleotide sequences encoding one or more rodent ADAM6 polypeptides, functional orthologs, functional homologs, or functional fragments thereof. In some embodiments, a genetically modified rodent (e.g., rat or mouse) as provided has a genome (e.g., a germline genome) comprising one or more nucleotide sequences encoding one or more rodent (e.g., rat or mouse) ADAM6 polypeptides, functional orthologs, functional homologs, or functional fragments thereof in place of a human Adam6 pseudogene. In some embodiments, a genetically modified rodent (e.g., rat or mouse) as provided has a genome (e.g., germline genome) comprising one or more nucleotide sequences encoding one or more rodent (e.g., rat or mouse) ADAM6 polypeptides, functional orthologs, functional homologs, or functional fragments thereof that replace a human Adam6 pseudogene.

In some embodiments, a genetically modified rodent as provided has a genome (e.g., a germline genome) comprising one or more human $V_H$ gene segments comprising a first and a second human $V_H$ gene segment, and one or more nucleotide sequences encoding one or more rodent (e.g., rat or mouse) ADAM6 polypeptides, functional orthologs, functional homologs, or functional fragments thereof between the first human $V_H$ gene segment and the second human $V_H$ gene segment. In some embodiments, a first human $V_H$ gene segment is $V_H1$-2 and a second human $V_H$ gene segment is $V_H6$-1.

In some embodiments, one or more nucleotide sequences encoding one or more rodent (e.g., a rat or mouse) ADAM6 polypeptides, functional orthologs, functional homologs, or functional fragments thereof are between a human $V_H$ gene segment and a human $D_H$ gene segment.

In some embodiments, one or more nucleotide sequences encoding one or more rodent ADAM6 polypeptides restore or enhance fertility in a male rodent.

In some embodiments, rodent animals described herein comprise an Adam6 gene as described in U.S. Pat. Nos. 8,642,835; 9,932,408; 8,687,940; and 9,944,716. In some embodiments, the heavy chain locus comprises a functional, e.g., ADAM6a gene, ADAM6b gene, or both. In some embodiments, the genome of the genetically modified non-human animal further comprises functional, e.g., ADAM6a gene, ADAM6b gene, or both, that are not located between mouse heavy chain variable region gene segments. Exemplary rodent animals expressing ADAM6a and/or ADAM6b are described in U.S. Pat. Nos. 8,642,835 and 8,697,940, each of which is hereby incorporated by reference in its entirety.

In some embodiments, a genetically modified rodent (e.g., rat or mouse) comprises an exogenous terminal deoxynucleotidyl transferase (TdT) gene. In some embodiments, a rodent (e.g., rat or mouse) that comprises an exogenous terminal deoxynucleotidyl transferase (TdT) gene can have increased antigen receptor diversity when compared to a rodent without an exogenous TdT gene.

In some embodiments, a rodent as described herein has a genome comprising an exogenous terminal deoxynucleotidyltransferase (TdT) gene operably linked to a transcriptional control element.

In some embodiments, a transcriptional control element includes a RAG1 transcriptional control element, a RAG2 transcriptional control element, an immunoglobulin heavy chain transcriptional control element, an immunoglobulin κ light chain transcriptional control element, an immunoglobulin light chain transcriptional control element, or any combination thereof.

In some embodiments, an exogenous TdT is located at an immunoglobulin κ light chain locus, an immunoglobulin λ light chain locus, an immunoglobulin heavy chain locus, a RAG1 locus, or a RAG2 locus.

In some embodiments, a TdT is a human TdT. In some embodiments, a TdT is a short isoform of TdT (ATS).

In some embodiments, rodents of this disclosure include, for example, a mouse, a rat, and a hamster. In some embodiments, a rodent is selected from the superfamily Muroidea. In some embodiments, a rodent of this disclosure is from a family selected from Calomyscidae (e mouse-like hamsters), Cricetidae (e.g., hamster, New World rats and mice, voles), Muridae (e.g., true mice and rats, gerbils, spiny mice, crested rats), Nesomyidae (climbing mice, rock mice, with-tailed rats, Malagasy rats and mice), Platacanthomyidae (e.g., spiny dormice), and Spalacidae (e.g., mole rats, bamboo rats, and zokors). In some embodiments, a rodent of this disclosure is selected from a true mouse or rat (family Muridae), a gerbil, a spiny mouse, and a crested rat. In some embodiments, a mouse of this disclosure is from a member of the family Muridae.

Phenotype of Genetically Modified Rodents

In some embodiments, a genetically modified rodent, whose genome comprises a nucleic acid molecule at an endogenous Scn9a locus, wherein the nucleic acid molecule is capable of encoding a NaV protein which comprises at least a portion of an exogenous Scn gene, expresses the NaV protein in the genetically modified rodent. In some embodiments, the NaV protein is expressed in a pattern comparable with, or substantially the same as, the rodent NaV1.7 protein in a control rodent (i.e., a rodent without the genetic modification at the endogenous Scn9a locus). A rodent NaV1.7 protein is known to be expressed in nociceptive (pain) neurons at dorsal root ganglion, sympathetic neurons, and neuroendocrine cells. In some embodiments, the NaV protein is expressed at a level comparable with, or substantially the same as, the rodent NaV1.7 protein in a control rodent (i.e., a rodent without the genetic modification at the endogenous Scn9a locus). The term "comparable" means that the patterns or levels being compared may not be identical to one another but permit comparison there between so that conclusions may reasonably be drawn based on differences or similarities observed; and the term "substantially the same" in referring to levels means that the levels being compared are not different from one another by more than 20%.

In some embodiments, a genetically modified rodent is capable of raising a humoral immune response following immunization with a NaV1.7 immunogen (e.g., a human NaV1.7 immunogen). A NaV1.7 immunogen can be a protein immunogen, a DNA immunogen, or a combination thereof. A humoral immune response in a rodent can be determined based on titers of antibodies in the serum specific for a NaV1.7 protein. A variety of assays can be employed to determined antibody titers, including EUSA and flow cytometry based assays (see, e.g., David H. Margulies. *Induction of Immune Responses, Current Protocols in Immunology*, 89, 1, (2.0.1-2.0.3) (2010); Henri V. van der Heyde et al., "Analysis of antigen-specific antibodies and their isotypes in experimental malaria," *Cytomeny*, Vol. 71A (4): 242-250 (2007); both incorporated herein by reference. In some embodiments, an assay utilizes cells that express or engineered to express NaV1.7 on the cell surface, and antibody titers can be determined by measuring antibody binding to the cells. In some embodiments, the cells are HEK cells engineered to express a human NaV1.7 protein. In some embodiments, antibody titer is defined as interpolated serum dilution factor of which the binding signal is 2 fold over background. In some embodiments, a genetically modified rodent disclosed herein produces antibodies against NaV1.7 (e.g., human NaV1.7) at a titer at least 5, 10, 20, 30, 40, 50, 60, 70, 80, 90, or 100-fold, or greater, as compared to a control rodent (i.e., a rodent without the genetic modification, i.e., not having at least a portion of an exogenous Seri gene inserted at an endogenous rodent Scn9a locus).

In some embodiments, a rodent is capable of generating antibodies specific for a NaV1.7 protein (e.g., a human NaV1.7 protein). In some embodiments, antibody specificity is determined based on a ratio of binding by an antibody to a cell line engineered to express a NaV1.7 protein relative to binding to the parental cell line without the engineered expression of the NaV1.7 protein. In some embodiments, an antibody has a specificity for NaV1.7 (such as, but not limited to, a human NaV1.7) at a ratio of at least 2, 3, 4, 5, 6, 7, 8, 9, 10, 15, 20, or a ratio greater than 20.

In some embodiments, a genetically modified rodent disclosed herein displays an impaired response to thermal stimuli. Response to thermal stimuli can be measured, e.g., in the Hargreaves test (a test which measures the rodent for their withdrawal latency to a radiant heat stimulus directed to the hindpaw; see, e.g., Shields et al., Journal of Neuroscience, 2018, 38(47):10180 10201), or in a hot plate apparatus which is set at a noxious temperature (e.g., 52.5° C. or 55° C.) (see, e.g., Shields et al. 2018, supra). In some embodiments, a genetically modified rodent disclosed herein (such as a hNav1.2 KI into mNav1.7 KO mouse) displays a prolonged latency to respond to a heat stimulus (e.g., a radiant heat stimulus in the Hargreaves test) as compared to wild type rodents, e.g., a genetically modified rodent takes at least 25%, 50%, 75%, or 100% longer time to respond to a heat stimulus as compared to a wild type rodent.

In some embodiments, a genetically modified rodent disclosed herein displays a reduced itch response to histamine. Itch response can be determined by injecting histamine intradermally in the nape of the neck of a rodent and measuring the number of scratching bouts within a specified period of time (see, e.g., see, Shields et al., 2018, supra). In some embodiments, a genetically modified rodent disclosed herein (such as a hNav1.2 KI into mNav1.7 mouse) displays a reduced itch response to histamine by showing a at least 25%, 50%, 75%, or 100% less in the number of scratching bouts than wild type rodents within a period of time such as 15 minutes, 20 minutes, 25 minutes or 30 minutes.

Genetically Modified Rodent Tissues and Cells

In another aspect of some embodiments, disclosed herein is an isolated rodent cell or tissue comprising a genetic modification at an endogenous rodent Scn9a locus as described herein.

In some embodiments, a rodent tissue is adipose, bladder, brain, breast, bone marrow, eye, heart, intestine, kidney, liver, lung, lymph node, muscle, pancreas, plasma, serum, skin, spleen, stomach, thymus, testis, ovum, or a combination thereof.

In some embodiments, a rodent cell is a lymphocyte. In some embodiments, a cell is selected from a B cell, dendritic cell, macrophage, monocyte, and a T cell.

In some embodiments, B cells of genetically modified rodents described herein are used in the production of antibodies that bind NaV1.7 (e.g., human NaV1.7). For example, B cells may be isolated from rodents described herein and used directly or immortalized for the generation of hybridomas. Such rodents may be immunized with a NaV1.7 immunogen (DNA or protein) prior to isolation of B cells from the rodents. B cells and/or hybridomas can be screened for binding to cells expressing NaV1.7 (e.g., human NaV1.7). Antibodies may be cloned and sequenced from such cells and used to generate candidate therapeutics.

In some embodiments, an immortalized cell made from an isolated rodent cell or rodent tissue as described herein is provided. Cells from rodents disclosed herein can be isolated and used on an ad hoc basis, or can be maintained in culture for many generations. In some embodiments, cells from a rodent disclosed herein are immortalized (e.g., via use of a virus, cell fusion, etc.) and maintained in culture indefinitely (e.g., in serial cultures).

In some embodiments, a rodent embryonic stem (ES) cell is provided whose genome comprises a genetic modification at an endogenous Scn9a locus as described herein. A rodent ES cell can be used to make a rodent embryo and a rodent animal.

In some embodiments, a rodent ES cell is a mouse embryonic stem cell and is, in some embodiments, from a 129 strain, C57BL strain, or a mixture thereof. In some embodiments, a rodent ES cell is a mouse embryonic stem cell and is a mixture of 12.9 and C57BL strains. In some embodiments, a rodent ES cell is a rat embryonic stem cell.

In some embodiments, an isolated rodent cell or rodent tissue comprises in its genome a humanized immunoglobulin heavy chain locus comprising one or more human $V_H$ gene segments, one or more human $D_H$ gene segments, and one or more human $J_H$ gene segments that are upstream of (e.g., operably linked to) one or more rodent (e.g., rat or mouse) immunoglobulin heavy chain constant region genes (e.g., one or more endogenous rodent (e.g., rat or mouse) immunoglobulin heavy chain constant region genes). Such a humanized immunoglobulin heavy chain locus is referred to herein as a "humanized HoH locus." In some embodiments, an isolated rodent cell or rodent tissue is homozygous at a humanized HoH locus. In some embodiments, an isolated rodent cell or rodent tissue is heterozygous at a humanized HoH locus.

In some embodiments, an isolated rodent cell is a B cell or splenocyte comprising a humanized HoH locus and produces an antibody comprising, inter alia, heavy chains, where each heavy chain comprises a human heavy chain variable domain operably linked to a rodent (e.g., rat or mouse) heavy chain constant domain, e.g., in response to antigenic stimulation.

In some embodiments, an isolated rodent cell or rodent tissue comprises in its genome a humanized immunoglobulin light chain locus comprising one or more human $V_L$ gene segments and one or more human $J_L$ gene segments that are upstream of (e.g., operably linked to) one or more immunoglobulin light chain constant region genes. In some embodiments, one or more human $V_L$ gene segments and one or more human $J_L$ gene segments are one or more human Vκ gene segments and one or more human Jκ gene segments. In some embodiments, one or more human $V_L$ gene segments and one or more human $J_L$ gene segments are one or more human Vλ gene segments and one or more human Jλ gene segments. In some embodiments, one or more immunoglobulin light chain constant region genes is or comprises a Cκ. In some embodiments, one or more immunoglobulin light chain constant region genes is or comprises a Cλ.

In some embodiments, an isolated rodent cell or rodent tissue comprises in its genome a humanized immunoglobulin light chain locus comprising one or more human Vκ gene segments and one or more human Jκ gene segments that are upstream of (e.g., operably linked to) a Cκ gene. Such a humanized immunoglobulin heavy chain locus is referred to herein as a "humanized KoK locus." In some embodiments, an immunoglobulin κ light chain constant region gene of a humanized KoK locus is a rodent (e.g., rat or mouse) Cκ gene. In some embodiments, an immunoglobulin κ light chain constant region gene of a humanized KoK locus is an endogenous rodent (e.g., rat or mouse) Cκ gene. In some embodiments, an immunoglobulin κ light chain constant region gene of a humanized KoK locus is an endogenous rodent (e.g., rat or mouse) Cκ gene at an endogenous immunoglobulin κ light chain locus. In some embodiments, an isolated rodent cell or rodent tissue is homozygous at a humanized KoK locus. In some embodiments, an isolated rodent cell or rodent tissue is heterozygous at a humanized KoK locus.

In some embodiments, an isolated rodent cell is a B cell or splenocyte comprising a humanized KoK locus and produces an antibody comprising, inter alia, κ light chains, where each κ light chain comprises a human κ light chain variable domain operably linked to a rodent (e.g., rat or mouse) κ light chain constant domain, e.g., in response to antigenic stimulation.

In some embodiments, an isolated rodent cell or rodent tissue comprises in its genome a humanized immunoglobulin light chain locus comprising one or more human Vλ gene segments upstream of (e.g., operably linked to) one or more human Jλ gene segments and one or more Cλ genes. Such a humanized immunoglobulin light chain locus is referred to herein as a "humanized LoL locus." In some embodiments, the one or more human Jλ gene segments and one or more Cλ genes of a humanized LoL locus are present in Jλ-Cλ clusters. In some embodiments, one or more Cλ genes of a humanized LoL locus comprise one or more human Cλ genes. In some embodiments, one or more Cλ genes of a humanized LoL locus comprise one or more mouse Cλ genes. In some embodiments, one or more Cλ genes of a humanized LoL locus comprise one or more human Cλ genes and one or more mouse Cλ genes. In some embodiments, one or more mouse Cλ genes of a humanized LoL locus comprise a mouse Cλ1 gene. In some embodiments, an isolated rodent cell or rodent tissue is homozygous at a humanized LoL locus. In some embodiments, an isolated rodent cell or rodent tissue is heterozygous at a humanized LoL locus.

In some embodiments, an isolated rodent cell is a B cell or splenocyte comprising a humanized LoL locus and produces an antibody comprising, inter alia, λ light chains, where each λ light chain comprises a human λ light chain variable domain operably linked to a rodent (e.g., rat or mouse) λ light chain constant domain, e.g., in response to antigenic stimulation. In some embodiments, an isolated rodent cell is a B cell or splenocyte comprising a humanized LoL locus and produces an antibody comprising, inter alia, λ light chains, where each λ light chain comprises a human λ light chain variable domain operably linked to a human λ light chain constant domain, e.g., in response to antigenic stimulation.

In some embodiments, an isolated rodent cell or rodent tissue comprises in its genome a humanized immunoglobulin light chain locus comprising one or more human Vλ gene segments and one or more human Jλ gene segments upstream of (e.g., operably linked to) a Cκ gene. Such a humanized immunoglobulin light chain locus is referred to herein as a "humanized LoK locus." In some embodiments, a Cκ gene of a humanized LoK locus is a rodent (e.g., rat or mouse) Cκ gene. In some embodiments, a Cκ gene of a humanized LoK locus is an endogenous rodent (e.g., rat or mouse) Cκ gene. In some embodiments, a Cκ gene of a humanized LoK locus is an endogenous rodent (e.g., rat or mouse) Cκ gene at an endogenous immunoglobulin κ light chain locus. In some embodiments, an isolated rodent cell or rodent tissue is homozygous at a humanized LoK locus. In some embodiments, an isolated rodent cell or rodent tissue is heterozygous at a humanized LoK locus.

In some embodiments, an isolated rodent cell is a B cell or splenocyte comprising a humanized LoK locus and produces an antibody comprising, inter alia, light chains, where each light chain comprises a human λ light chain variable domain operably linked to a rodent (e.g., rat or mouse) κ light chain constant domain, e.g., in response to antigenic stimulation.

In some embodiments, an isolated rodent cell or rodent tissue comprises in its genome a humanized immunoglobulin κ light chain locus comprising one or more human Vλ gene segments and one or more human Jλ gene segments upstream of (e.g., operably linked to) a Cλ gene. Such a humanized immunoglobulin light chain locus is referred to herein as a "humanized LiK locus." In some embodiments, a Cλ gene of a humanized LiK locus is a rodent (e.g., rat or mouse) Cλ gene. In some embodiments, a Cλ gene of a humanized LiK locus is a mouse Cλ1 gene. In some embodiments, an isolated rodent cell or rodent tissue is homozygous at a humanized LiK locus. In some embodiments, an isolated rodent cell or rodent tissue is heterozygous at a humanized LiK locus.

In some embodiments, an isolated rodent cell is a B cell or splenocyte comprising a humanized LiK locus and produces an antibody comprising, inter alia, λ, light chains, where each λ light chain comprises a human λ light chain variable domain operably linked to a rodent (e.g., rat or mouse) λ light chain constant domain, e.g., in response to antigenic stimulation.

In some embodiments, an isolated rodent cell or rodent tissue comprises in its genome a humanized immunoglobulin κ light chain locus comprising one or more human Vλ gene segments upstream of (e.g., operably linked to) one or more human Jλ gene segments and one or more human Cλ genes. In some embodiments, the one or more human Jλ gene segments and one or more Cλ genes of such a humanized immunoglobulin κ light chain locus are present in Jλ-Cλ clusters. In some embodiments, an isolated rodent cell or rodent tissue is homozygous for such a humanized immunoglobulin κ light chain locus. In some embodiments, an isolated rodent cell or rodent tissue is heterozygous for such a humanized immunoglobulin κ light chain locus. In some embodiments, an isolated rodent cell is a B cell or splenocyte, which comprises such a humanized immunoglobulin κ light chain locus, and produces an antibody comprising, inter alia, light chains, where each λ light chain comprises a human λ light chain variable domain operably linked to a human λ light chain constant domain, e.g., in response to antigenic stimulation.

In some embodiments, an isolated rodent cell or rodent tissue comprises in its genome a humanized HoH locus and a humanized KoK locus. In some embodiments, an isolated rodent cell or rodent tissue comprises in its genome a humanized HoH locus and a humanized LoL locus. In some embodiments, an isolated rodent cell or rodent tissue comprises in its genome a humanized HoH locus a humanized KoK locus and a humanized LoL locus. In some embodiments, an isolated rodent cell or rodent tissue is homozygous at a humanized HoH locus, a humanized KoK locus, a humanized LoL locus, or a combination thereof.

In some embodiments, an isolated rodent cell or rodent tissue comprises in its genome a humanized HoH locus, a humanized KoK locus, and a humanized LoK locus. In some embodiments, an isolated rodent cell or rodent tissue comprises in its genome a humanized HoH locus, a humanized KoK locus, and a humanized LiK locus.

In some embodiments, an isolated rodent cell or rodent tissue comprises in its genome a humanized HoH locus and a humanized LoK locus. In some embodiments, an isolated rodent cell or rodent tissue is homozygous at a humanized HoH locus, a humanized LoK locus, or a combination thereof.

In some embodiments, an isolated rodent cell or rodent tissue comprises in its genome a humanized HoH locus and a humanized LiK locus. In some embodiments, an isolated rodent cell or rodent tissue is homozygous at a humanized HoH locus, a humanized LiK locus, or a combination thereof.

In some embodiments, an isolated rodent cell or rodent tissue comprises in its genome a humanized LoH locus and a humanized KoK locus. In some embodiments, an isolated rodent cell or rodent tissue comprises in its genome a humanized LoH locus and a humanized LoL locus. In some embodiments, an isolated rodent cell or rodent tissue comprises in its genome a humanized LoH locus, a humanized KoK locus, and a humanized LoL locus. In some embodiments, an isolated rodent cell or rodent tissue is homozygous at a humanized locus, a humanized KoK locus, a humanized LoL locus, or a combination thereof.

In some embodiments, an isolated rodent cell or rodent tissue comprises in its genome) a humanized LoH locus, a humanized KoK locus, and a humanized LoK locus. In some embodiments, an isolated rodent cell or rodent tissue comprises in its genome a humanized LoH locus, a humanized KoK locus, and a humanized LiK locus.

In some embodiments, an isolated rodent cell or rodent tissue comprises in its genome a humanized LoH locus and a humanized LoK locus. In some embodiments, an isolated rodent cell or rodent tissue is homozygous at a humanized LoH locus, a humanized LoK locus, or a combination thereof.

In some embodiments, an isolated rodent cell or rodent tissue comprises in its genome a humanized LoH locus and a humanized LiK locus. In some embodiments, an isolated rodent cell or rodent tissue is homozygous at a humanized LoH locus, a humanized LiK locus, or a combination thereof.

In some embodiments, an isolated rodent cell or rodent tissue as provided herein has a genome comprising a humanized immunoglobulin heavy chain (e.g., HoH or LoH) locus lacking an endogenous rodent Adam6 gene. In some embodiments, an isolated rodent cell or rodent tissue as provided herein has a genome comprising one or more nucleotide sequences encoding one or more rodent ADAM6 polypeptides, orthologs, homologs, or fragments thereof. In some embodiments, an isolated rodent cell or rodent tissue as provided expresses one or more rodent (e.g., rat or mouse) ADAM6 polypeptides, orthologs, homologs, or fragments thereof. In some embodiments, an isolated rodent cell or rodent tissue as provided has a genome comprising one or more nucleotide sequences encoding one or more rodent (e.g., rat or mouse) ADAM6 polypeptides, orthologs, homologs, or fragments thereof that are included on the same chromosome as a humanized immunoglobulin heavy chain (e.g., or LOH) locus. In some embodiments, an isolated rodent cell or rodent tissue as provided has a genome comprising a humanized immunoglobulin heavy chain (e.g., HoH or LoH) locus comprising one or more nucleotide sequences encoding one or more rodent ADAM6 polypeptides, orthologs, homologs, or fragments thereof. In some embodiments, an isolated rodent cell or rodent tissue as provided has a genome comprising one or more nucleotide sequences encoding one or more rodent (e.g., rat or mouse) ADAM6 polypeptides, orthologs, homologs, or fragments thereof in place of a human Adam6 pseudogene. In some embodiments, an isolated rodent cell or rodent tissue as provided has a genome comprising one or more nucleotide sequences encoding one or more rodent (e.g., rat or mouse) ADAM6 polypeptides, orthologs, homologs, or fragments thereof that replace a human Adam6 pseudogene.

In some embodiments, an isolated rodent cell or rodent tissue as provided has a genome comprising one or more human $V_H$ gene segments comprising a first and a second human $V_H$ gene segment, and one or more nucleotide sequences encoding one or more rodent (e.g., rat or mouse) ADAM6 polypeptides, orthologs, homologs, or fragments thereof between the first human $V_H$ gene segment and the second human $V_H$ gene segment. In some embodiments, a first human $V_H$ gene segment is $V_H$1-2 and a second human $V_H$ gene segment is $V_H$6-1.

In some embodiments, one or more nucleotide sequences encoding one or more rodent (e.g., a rat or mouse) ADAM6 polypeptides, orthologs, homologs, or fragments thereof are between a human $V_H$ gene segment and a human $D_H$ gene segment.

In some embodiments, an isolated rodent cell or rodent tissue comprises an exogenous terminal deoxynucleotidyl transferase (TdT) gene. In some embodiments, an isolated rodent cell is a B cell or splenocyte comprising an exogenous terminal deoxynucleotidyl transferase (TdT) gene and can have increased antigen receptor diversity when compared to an isolated rodent cell (e.g., B cell or splenocyte) without an exogenous TdT gene.

In some embodiments, an isolated rodent cell or rodent tissue as described herein has a genome comprising an exogenous terminal deoxynucleotidyltransferase (TdT) gene operably linked to a transcriptional control element.

In some embodiments, a transcriptional control element includes a RAG1 transcriptional control element, a RAG2 transcriptional control element, an immunoglobulin heavy chain transcriptional control element, an immunoglobulin κ light chain transcriptional control element, an immunoglobulin λ light chain transcriptional control element, or any combination thereof.

In some embodiments, an exogenous TdT is located at an immunoglobulin κ light chain locus, an immunoglobulin λ light chain locus, an immunoglobulin heavy chain locus, a RAG1 locus, or a RAG2 locus.

In some embodiments, a TdT is a human TdT. In some embodiments, a TdT is a short isoform of TdT (TdTS).

Compositions and Methods for Making Genetically Modified Rodents

In an aspect of some embodiments, disclosed here are methods for making a genetically modified rodent described above, as well as nucleic acid vectors suitable for use in making a genetically modified rodent.

In some embodiments, disclosed herein is a targeting vector (or nucleic acid construct) that comprises an exogenous Scn gene desired to be integrated into a rodent Scn9a locus. In some embodiments, disclosed herein is a targeting vector (or nucleic acid construct) that comprises at least a portion of an exogenous Scn gene desired to be integrated into a rodent Scn9a locus. In some embodiments, a target vector comprises a portion of an exogenous Scn gene that encodes contiguous amino acids of an extracellular domain of the NaV protein encoded by the exogenous Scn gene. In some embodiments, a target vector comprises portions of an exogenous Scn gene that encode the amino acids of the extracellular domains of the NaV protein encoded by the exogenous Scn gene, and also comprises portions of the endogenous Scn9a gene that encode the amino acids of the transmembrane and cytoplasmic domains, where the transmembrane and cytoplasmic domains are operably linked with one another. In some embodiments, a target vector comprises the coding sequence of an exogenous Scn gene. In some embodiments, the targeting vector also includes 5' and 3' rodent sequences flanking the nucleotide sequence to be integrated into a rodent Scn9a locus, also known as homology arms, that mediate homologous recombination and integration of the nucleotide sequence into the target rodent Scn9a locus. In some embodiments, the homology arms comprise nucleotide sequences that flank the nucleotide sequence at the target rodent locus that is to be replaced. In an exemplary embodiment, the coding sequence from the start codon to the stop codon of an endogenous rodent Scn9a gene is replaced with a coding sequence of a human SCN2A gene, the 5' flanking sequence can include sequences upstream of the ATG codon of the endogenous rodent Scn9a gene, and the 3' flanking sequence can include sequences downstream of the stop codon of the endogenous rodent Scn9a gene.

In some embodiments, a targeting vector comprises a selection marker gene. In some embodiments, a targeting vector comprises one or more site-specific recombination sites. In some embodiments, a targeting vector comprises a selection marker gene, flanked by site-specific recombination sites, such that the selection marker gene can be deleted as a result of recombination between the sites.

In exemplary embodiments, a bacterial artificial chromosome (BAC) clone carrying a rodent genomic fragment of a rodent Scn9a gene can be modified using bacterial homologous recombination and VELOCIGENE® technology (see, e.g., U.S. Pat. No. 6,586,251 and Valenzuela et al. (2003) *Nature Biotech.* 21(6):652-659; all incorporated herein by reference in their entireties). As a result, a rodent Scn9a genomic sequence is deleted from the original BAC clone, and an exogenous Scn nucleotide sequence is inserted, resulting in a modified BAC clone carrying an exogenous Scn nucleotide sequence, flanked with 5' and 3' rodent homology arms. The modified BAC clone, once linearized, can be introduced into rodent embryonic stem (ES) cells.

In some embodiments, the present invention provides use of a targeting vector as described herein to make a modified rodent embryonic stem (ES) cell. For example, a targeting vector can be introduced into a rodent ES cell by, e.g., electroporation. Both mouse ES cells and rat ES cells have been described in the art. See, e.g., U.S. Pat. Nos. 7,576,259, 7,659,442, 7,294,754, and US 2008-0078000 A1 that describe mouse ES cells and the VELOCIMOUSE® method for making a genetically modified mouse; US 2014/02359:33 A1 (Regeneron Pharmaceuticals Inc.), US 2014/0310828 A1 (Regeneron Pharmaceuticals Inc.), Tong et al. (2010) *Nature* 467:211-215, and Tong et al. (2011) *Nat Protoc.* 6(6): doi:10.1038/nprot.2011.338 that describe rat ES cells and methods for making a genetically modified rat, which can be used to make a modified rodent embryo, which in turn can be used to make a rodent animal.

In some embodiments, a modified rodent ES cell described herein comprises in its genome a humanized HoH locus and a humanized KoK locus. In some embodiments, a modified rodent ES cell described herein comprises in its genome a humanized HoH locus and a humanized LoL locus. In some embodiments, a modified rodent ES cell described herein comprises in its genome a humanized HoH locus, a humanized KoK locus, and a humanized LoL locus. In some embodiments, a modified rodent ES cell described herein is homozygous at a humanized HoH locus, a humanized KoK locus, a humanized LoL locus, or a combination thereof.

In some embodiments, a modified rodent ES cell described herein comprises in its genome a humanized HoH locus, a humanized KoK locus, and a humanized LoK locus. In some embodiments, a modified rodent ES cell described herein comprises in its genome a humanized HoH locus, a humanized KoK locus, and a humanized LiK locus.

In some embodiments, a modified rodent ES cell described herein comprises in its genome a humanized HoH locus and a humanized LoK locus. In some embodiments, a modified rodent ES cell described herein is homozygous at a humanized HoH locus, a humanized LoK locus, or a combination thereof.

In some embodiments, a modified rodent ES cell described herein comprises in its genome a humanized HoH locus and a humanized LiK locus. In some embodiments, a modified rodent ES cell described herein is homozygous at a humanized Hoff locus, a humanized LiK locus, or a combination thereof.

In some embodiments, a modified rodent ES cell described herein comprises in its genome a humanized LoH locus and a humanized KOK locus. In some embodiments, a modified rodent ES cell described herein comprises in its genome a humanized LoH locus and a humanized LoL locus. In some embodiments, a modified rodent ES cell described herein comprises in its genome a humanized LoH locus, a humanized KoK locus, and a humanized LoL locus. In some embodiments, a modified rodent ES cell described herein is homozygous at a humanized LoH locus, a humanized KoK locus, a humanized LoL, locus, or a combination thereof.

In some embodiments, a modified rodent ES cell described herein comprises in its genome a humanized LoH locus, a humanized KoK locus, and a humanized LoK locus. In some embodiments, a modified rodent ES cell described herein comprises in its genome a humanized LoH locus, a humanized KoK locus, and a humanized LiK locus.

In some embodiments, a modified rodent ES cell described herein comprises in its genome a humanized LoH locus and a humanized LoK locus. In some embodiments, a modified rodent ES cell described herein is homozygous at a humanized LoH locus, a humanized LoK locus, or a combination thereof.

In some embodiments, a modified rodent ES cell described herein comprises in its genome a humanized LoH locus and a humanized LiK locus. In some embodiments, a modified rodent ES cell described herein is homozygous at a humanized LoH locus, a humanized LiK locus, or a combination thereof.

In some embodiments, ES cells having an exogenous Scn nucleotide sequence integrated in the genome can be selected. In some embodiments, ES cells are selected based on loss of rodent allele and/or gain of exogenous nucleotide sequence assays. In some embodiments, selected ES cells are then used as donor ES cells for injection into a pre-morula stage embryo (e.g., 8-cell stage embryo) by using the VELOCIMOUSE® method (see, e.g., U.S. Pat. Nos. 7,576,259, 7,659,442, 7,294,754, and US 2008-0078000 A1), or methods described in US 2014/0235933 A1 and US 2014/0310828 A1. In some embodiments, modified rodent ES cells comprise a humanized immunoglobulin heavy and/or light chain locus and an exogenous Scn sequence and the modified rodent ES cells can be introduced into an embryo. The embryo comprising the donor ES cells is incubated until blastocyst stage and then implanted into a surrogate mother to produce an F0 rodent fully derived from the donor ES cells. Rodent pups bearing an exogenous Scn nucleotide sequence can be identified by genotyping of DNA isolated from tail snips using loss of rodent Scn9a sequence and/or gain of exogenous Scn sequence assays.

In some embodiments, rodents heterozygous for a genetic modification at an endogenous Scn9a locus can be crossed (or cross-bred) to generate homozygous rodents, e.g., by following breeding protocols readily available in the art; see, e.g., JoVE Science Education Database. *Lab Animal Research, Fundamentals of Breeding and Weaning*, JoVE, Cambridge, Mass., (2018) (video article); *Breeding Strategies for Maintaining Colonies of Laboratory Mice, A Jack-* son *Laboratory Resource Manual,* ©2007 The Jackson Laboratory; all incorporated in their entireties herein by reference.

In some embodiments, rodents comprising a genetic modification at an endogenous Scn9a locus can be crossed with rodents comprising a human or humanized immunoglobulin heavy and/or light chain locus to obtain rodents comprising both the genetic modification at an endogenous Scn9a locus and a human or humanized immunoglobulin heavy and/or light chain locus as described above. In some embodiments, a rodent ES cell comprising a humanized immunoglobulin heavy and/or light chain locus can be used to receive an exogenous Scn sequence for integration into an endogenous Scn9a locus, and the resulting genetically modified rodent ES cell can be used for making a genetically modified rodent comprising both the genetic modification at an endogenous Scn9a locus and a humanized immunoglobulin heavy and/or light chain locus.

Methods Employing Genetically Modified Rodents

In some embodiments, genetically modified rodents described herein are used to generate antibodies against a NaV1.7 protein (e.g., a human NaV1.7 protein).

In some embodiments, antibodies can be generated by administering a NaV1.7 immunogen (e.g., a human NaV1.7) to a rodent animal described herein via various routes (e.g., but not limited to, an intravenous or an intraperitoneal route). A NaV1.7 immunogen is a protein immunogen (i.e., a NaV1.7 protein or a fragment thereof), a DNA immunogen (a DNA capable of expressing a NaV1.7 protein or a fragment thereof in a recipient rodent, e.g., a viral vector), or a combination thereof. In some embodiments, the immunogen is a recombinant NaV1.7 protein expressed in *E. coli* or in a eukaryotic (e.g., yeast) or mammalian cells (e.g., Chinese hamster ovary (CHO) cells). In some embodiments, one or more booster injections may be administered using standard adjuvants. The booster injections can employ the same NaV1.7 immunogen, or switch from an original protein immunogen to a DNA immunogen or vice versa. Lymphatic cells (such as B-cells) are recovered from the immunized rodent, and can be screened directly, or can be fused with a myeloma cell line to prepare immortal hybridoma cell lines which are then screened, to identify cells that produce antibodies specific to NaV1.7. The screening can be based on evaluating binding of a candidate antibody to cells engineered to express a NaV1.7 protein (e.g., HEK cells engineered to express human NaV1.7) as compared to binding to parental cells that do not express the NaV1.7 protein (HEK cells). In some embodiments, a ratio of binding to cells engineered to express a NaV1.7 protein as compared to binding to parental cells that do not express the NaV1.7 protein at a specified antibody concentration is used to measure specificity of the antibody, and the antibody can be identified as a specific binder to the NaV1.7 protein if the ratio is at least 2, 3, 4, 5, 6, 7, 8, 9 or 10, or a ratio greater than 10.

DNA encoding the variable regions of the heavy chain and light chain of the identified cells can be isolated and linked to desirable heavy and light constant regions. Such an antibody protein may be produced in a cell, such as a CHO cell.

The present description is further illustrated by the following examples, which should not be construed as limiting in any way. The contents of all cited references (including literature references, issued patents, and published patent applications as cited throughout this application) are hereby expressly incorporated by reference.

EXAMPLES

Example 1. Generation of a Mouse Strain Comprising a Human NaV1.2 Knock in (M) into Mouse NaV1.7 Knock Out (KO)

This example illustrates exemplary methods of generating a genetically modified rodent (e.g., a mouse) wherein a rodent Scn gene (e.g., a mouse Scn9a gene, which encodes mouse NaV1.7 protein) is replaced, in whole or in part, by a Scn gene from a different species (e.g., a human SCN2A gene, which encodes human NaV1.2 protein).

A targeting vector for modifying an endogenous mouse Scn9a gene was constructed as follows using bacterial artificial chromosome (BAC) clones and VELOCIGENE® technology (see, e.g., U.S. Pat. No. 6,586,251 and Valenzuela et al. (2003) High-throughput engineering of the mouse genome coupled with high-resolution expression analysis, *Nature Biotech.* 21(6):652-659, which are herein incorporated by reference in their entireties).

Briefly, bacterial artificial chromosome (BAC) clone RP23-454H3 containing a mouse Scn9a gene was modified through homologous recombination in bacterial cells using a DNA fragment that contained a human SCN2A genomic DNA of 96,735 bp from BAC clone RP11-422D18 and a self-deleting neomycin cassette of 4809 bp (loxP-mPrm1-Crei-pA-hUb1-em7-Neo-pA-loxP). The human SCN2A genomic DNA contained human SCN2A ATG to 2734 bp beyond the stop codon, which included about 250 bp of 3' human sequence after the human 3' UTR just before the cassette. As a result of the homologous recombination, a mouse nucleotide sequence of 84,847 bp (from the ATG start codon to the stop codon of the mouse Scn9a gene) in BAC clone RP23-454H3 was replaced by the human sequence of 96,735 bp, followed by the cassette. The resulting, modified BAC clone, with a 5' homology arm of 57 Kb and a 3' homology arm of 43 Kb flanking the human SCN2A genomic DNA and self-deleting cassette, was used as a targeting vector for modifying an endogenous mouse Scn9a gene. See FIGS. 1A-1B.

Figure 1A:
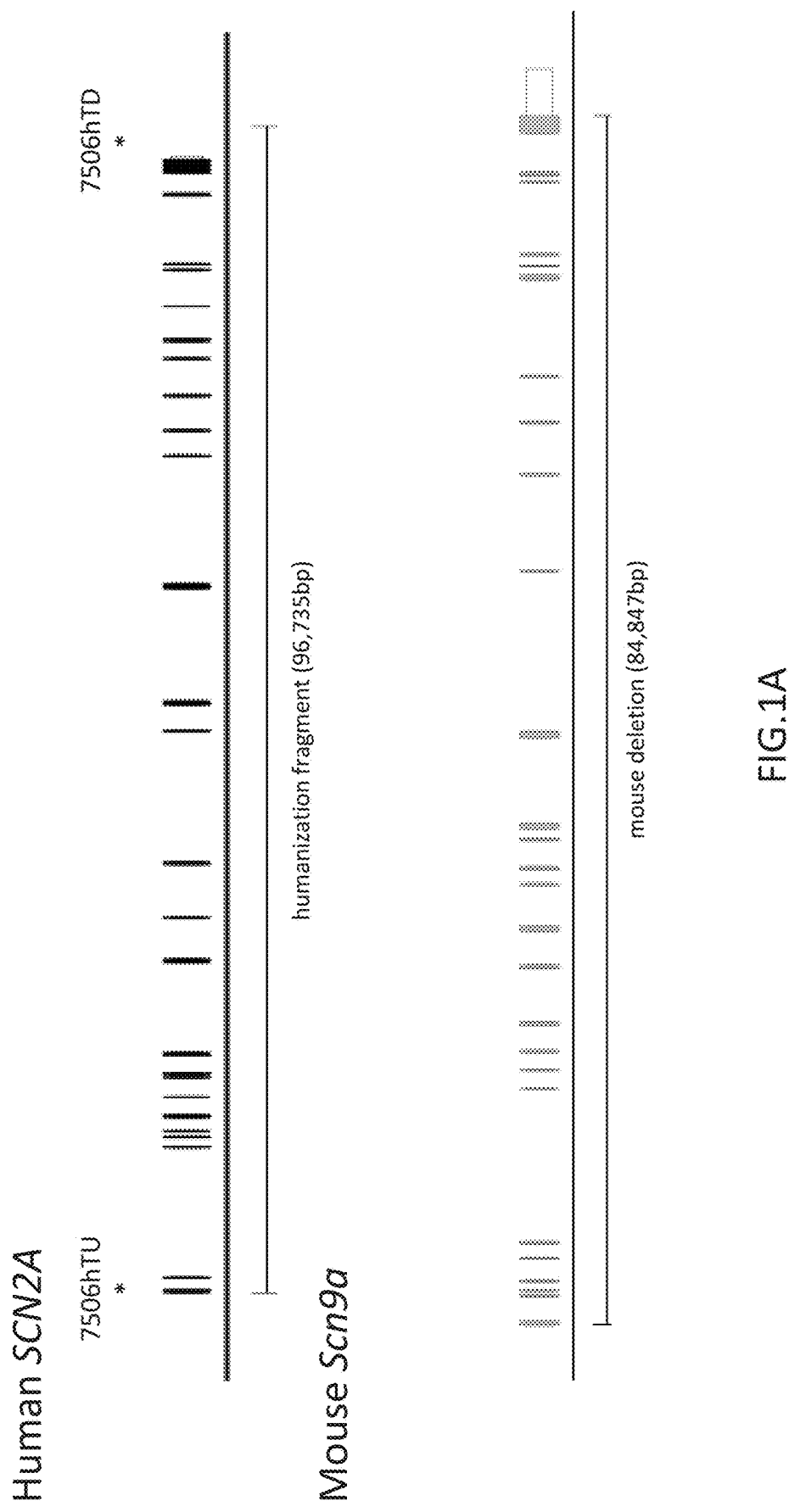
Figure 1B:
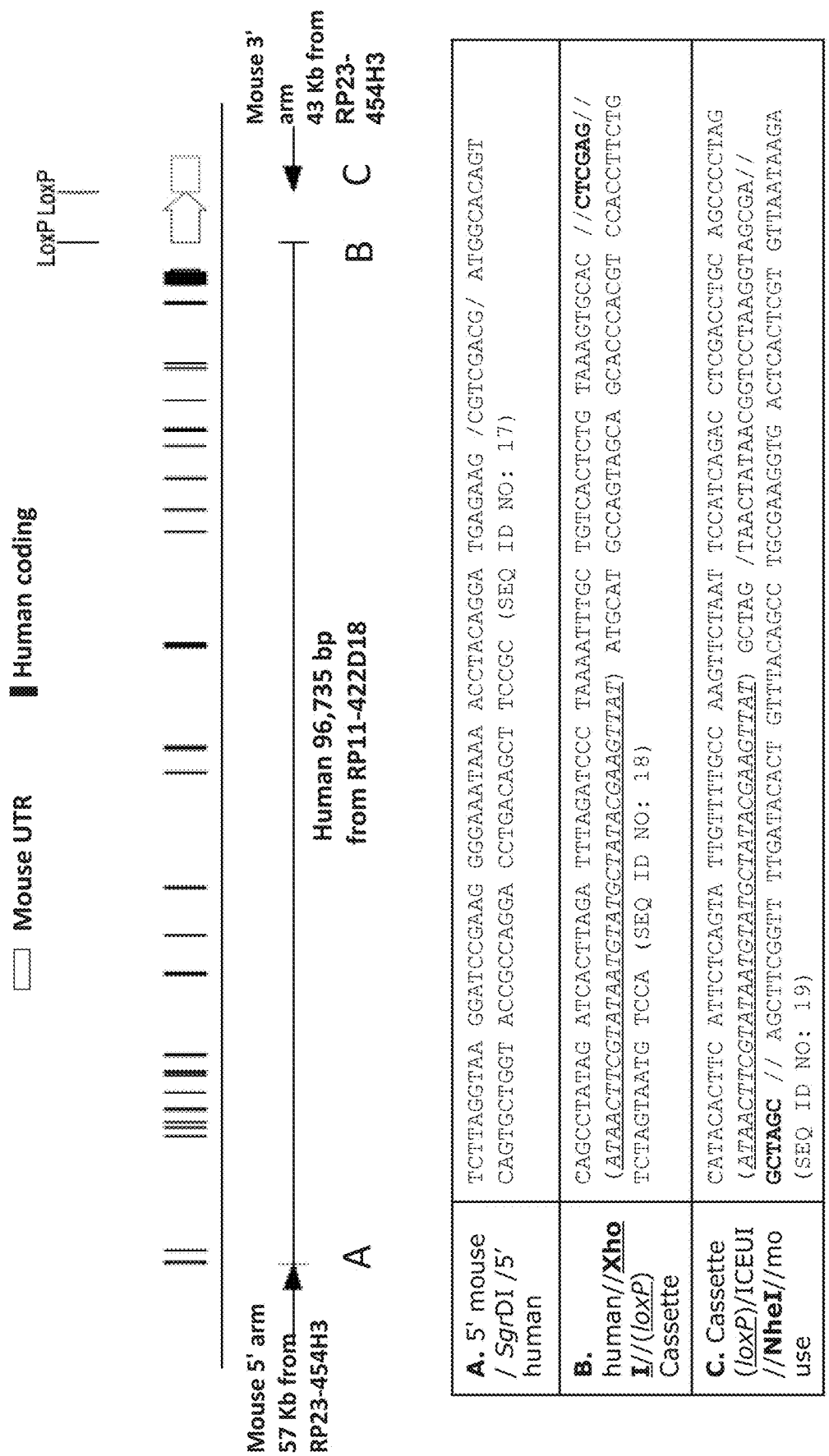
Figure 1C:
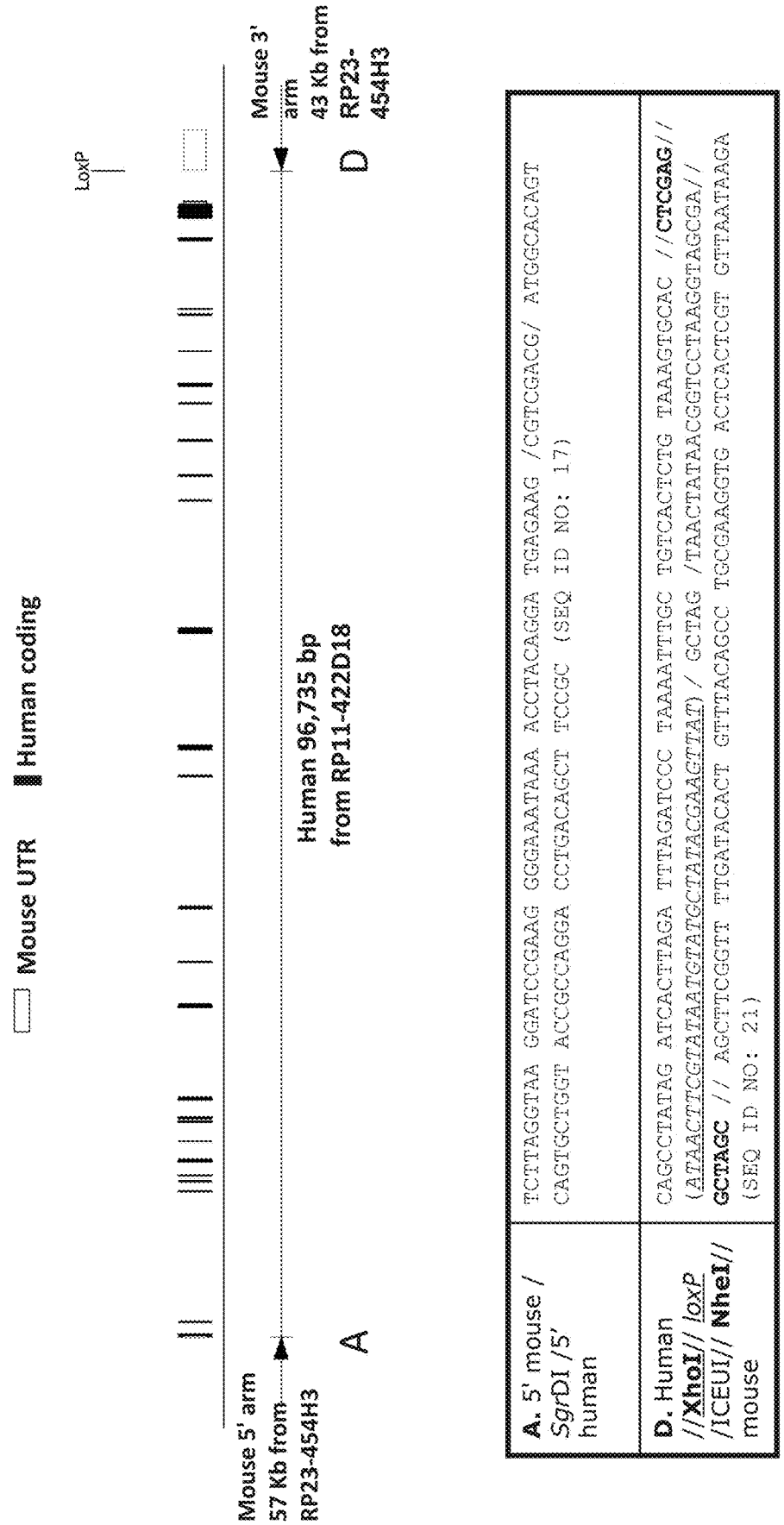

The modified BAC clone was introduced into mouse embryonic stem (ES) cells by electroporation. Positively targeted ES cells containing a human SCN2A gene which replaced a mouse Scn9a gene at an endogenous mouse Scn9a locus ("human SCN2A KI into a mouse Scn9a KO", or "hNaV1.2 KI into mNaV1.7 KO") were identified by an assay (Valenzuela et al., supra) that detected the presence of human sequences and confirmed the loss and/or retention of mouse sequences. Table 5 sets forth the primers and probes that were used in the assay. See also FIG. 1A depicting the locations of the primers and probes used in the assay. The nucleotide sequence of a successfully modified Scn9a locus is set forth in SEQ ID NO: 20. After selecting a targeted ES cell clone having the desired modification, the neomycin selection cassette can be excised by introducing a Cre recombinase, e.g., via electroporation. Alternatively, the neomycin selection cassette can be removed by crossing the progeny generated from the ES clone with a deletor rodent strain that expresses a Cre recombinase. A modified Scn9a locus after the deletion of the cassette is depicted in FIG. 1C, with junction sequences shown at the bottom of FIG. 1C.

TABLE 5

| | | Mouse TaqMan Loss of allele assays |
|---|---|---|
| 867TU | Fwd | TCTGGGCAGGTACTTGTGG (SEQ ID NO: 5) |
| | Probe (BHQ) | AATACGTTGAGCACAGAGGTCAGAAGGA (SEQ ID NO: 6) |
| | Rev | GTTGCTCTGCTTTCTTGAACCTC (SEQ ID NO: 7) |
| 867TD | Fwd | ATGTCAGCCAATCCTTCTAAAGTG (SEQ ID NO: 8) |
| | Probe (BHQ) | TCCTATGAGCCCATCACAACCACAC (SEQ ID NO: 9) |
| | Rev | CGTTTTGCCTAAGGCGGTAC (SEQ ID NO: 10) |
| | | Human TaqMan Gain of allele assays |
| 7506hTU | Fwd | GACCGTGTAATGGACCAATGATC (SEQ ID NO: 11) |
| | Probe (BHQ) | TTTGGAAGCACTCATTTGAACCTGCA (SEQ ID NO: 12) |
| | Rev | CACCAGTTCTCTGCCTGTCTC (SEQ ID NO: 13) |
| 7506hTD | Fwd | TCAGGTGGATGTCACAGTCA (SEQ ID NO: 14) |
| | Probe (BHQ) | TCTGTTCCTAGCACTTTTAAATTGAAGCAC (SEQ ID NO: 15) |
| | Rev | TGCATCCTAGTCCTTGCTTCTTA (SEQ ID NO: 16) |

Selected ES cell clones (with or without the cassette) were used to implant female mice using the VELOCEMOUSE® method (see, e.g., U.S. Pat. No. 7,294,754 and Poueymirou et al., 2007, Nature Biotech. 25(0:91-99) to generate a litter of pups containing a humanized Scn9a locus in the genome. Mice bearing such genetic modification were again confirmed and identified by genotyping of DNA isolated from tail snips using a modification of allele assay (Valenzuela et al, supra) that detects the presence of the human sequences. Animals homozygous for a humanized Scn9a locus were made by crossing heterozygous animals.

Example 2. Immunization of hNaV1.2 Knock in (KI) into mNaV1.7 Knock Out (KO)/VI-3 Mice and Analysis of Serum Antibody Responses to Immunogens Immunization, Human NaV1.2 knock in (KI) into mNaV1.7 KO/VI-3 mice were immunized with either full length DNA encoding a full length human Nav1.7 protein or human NaV1.7 protein. The mice were boosted via different routes at varying time intervals using standard adjuvants. The mice were bled prior to the initiation of immunization and periodically following immunogen boosts and anti-serum titers were assayed on respective antigens.

Anti-serum Titer Determination. Antibody titers in serum against respective immunogens were determined using Meso Scale Discovery (MSD) cell binding ELISA. Ninety-six-well carbon surface plates were coated with 40,000 cells/well of HEK293/hNav1.7-GFP (from Sanofi, SA), HEK293/hNav1.7 (Millipore) and HEK293 parental cells in PBS at 37° C. for 1 hour. The cell coating solution was decanted and the plates were blocked with 150 μL of 2% bovine serum albumin (BSA, Sigma-Aldrich) in PBS for 1 h at room temperature (RT). Plates were washed with PBS three times using a plate washer (AquaMax®2000 from Molecular Devices). Pre-immune and immune anti-sera were serially diluted three-fold in 1% BSA-PBS and added to the plates for 1 h at room temperature. The plates were washed and goat anti-mouse IgG-Fc ruthenium conjugated secondary antibody was then added to the plates at 1 μg/mL and incubated for 1 hour at RT. Plates were washed and developed by adding 150 μl per well MSD's 4× surfactant free Read Buffer T (diluted to 1×) and read on MSD SECTOR™ imager 6000 instrument. Anti-serum titers were computed using Graphpad PRISM software. The titer is defined as interpolated serum dilution factor of which the binding signal is 2 fold over background.

Figure 2:
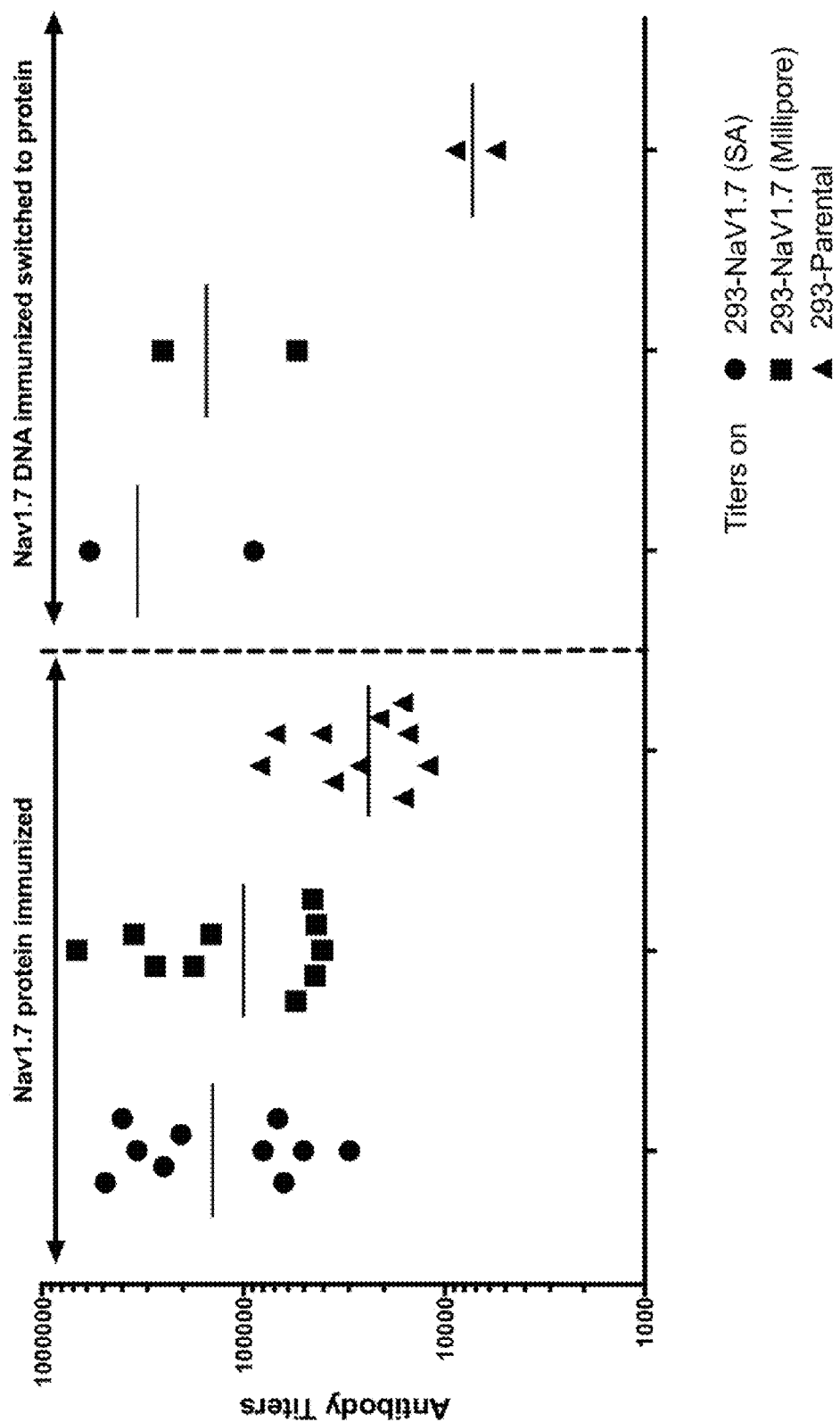
FIG. 2. is an embodiment showing an exemplary analysis of immune responses in hNaV1.2 KI into mNaV1.7 KO/VI-3 mice using protein and DNA immunogens. Mice were initially immunized with DNA immunogen and switched to protein immunogen as boosts. As used herein, the term "VI-3" refers to an embodiment of a mouse as disclosed herein that includes an HoH locus and a KoK locus. In particular, a VI-3 mouse, as that term is used herein, is homozygous for an HoH locus comprising 80 human $V_H$ gene segments, 27 human $D_H$ gene segments, and six human $J_H$ gene segments; the VI-3 mouse is also homozygous for a KoK locus comprising 40 human Vκ gene segments and at least one human Jκ gene segment.

Results. The Immoral immune responses in hNav1.2 KI into mNav1.7 KO/VI-3 mice were investigated following immunization with protein or DNA immunogens. Antisera from mice immunized with protein show high, specific titers on Nav1.7 over-expressing cells, with lower binding on parental cells (FIG. 2). Protein boosts were administered to mice with low responses initially immunized with DNA, which led to elicitation of high, specific titers on Nav1.7 engineered cells (FIG. 2).

Example 3. Electrochemiluminescent Cell Binding of Antibodies from Human NaV1.2 KI into mNaV1.7 KO VI Mice-Supernatants from Primary Screening and Purified Antibodies Experimental Procedure Human NaV1.2 KI into NaV1.7 KO VI mice, described in Example 1, were immunized with a purified detergent solubilized human NaV1.7 protein. Monoclonal antibodies were generated by fusions of splenocytes from these immunized mice with mouse myeloma P3X63Ag8.653 cells. Supernatants from the hybridomas were evaluated for their ability to bind to human NaV1.7 expressing cells using electrochemiluminescence (ECL) based detection. Positive NaV1.7 cell binders were evaluated for specificity by comparison of binding on NaV1.7 engineered cells and a reference cell line. A subset of 24 NaV1.7-specific hybridomas were single cell sorted by flow cytometry, expanded and antibodies were purified. The ability of these antibodies to specifically bind to cells engineered to express NaV1.7 was determined.

Briefly, human embryonic kidney cells, (HEK293) engineered to express human NaV1.7 were obtained from two sources, Sanofi (SA 293/GFP-hNaV1.7, abbreviated "SA" as shown in FIG. 2) and Millipore (Millipore 293/hNaV1.7, abbreviated "Millipore" as shown in FIG. 2). HEK293 cells from ATCC were used as a NaV1.7 baseline reference, as they have low levels of NaV1.7 mRNA as determined by TAQMAN analysis. A previously isolated anti-human NaV1.7 antibody was used as a NaV1.7 positive cell binding control. An irrelevant mouse IgG antibody (either anti-hCD48 mIgG1 or anti-hIgG4 mIgG2a control) was used as a negative binding control in the assays.

Experiments were done according to the following procedure. Cells from lines described above were rinsed once in 1×PBS buffer without $Ca^{2+}/Mg^{2+}$ and incubated for 10 minutes at 37° C. with Enzyme Free Cell Dissociation Solution to detach cells from a flask. All cells were washed once with 1×PBS with $Ca^{2+}/Mg^{2+}$ and counted with a Cellometer™ Auto T4 cell counter (Nexcelom Bioscience LLC, Lawrence, Mass.). Approximately $2.0 \times 10^4$ HEK293, SA 293/GFP-hNaV1.7, and Millipore 293/hNaV1.7 cells were seeded separately onto 96-well carbon electrode plates (MULTI-ARRAY high bind plate, Meso Scale Discovery (MSD, Rockville, Md.)) and incubated for 1 hour at 37° C. Nonspecific binding sites were blocked with 2% BSA (w/v) in 1×PBS with $Ca^{2+}/Mg^{2+}$ for 1 hour at room temperature (RT). To the plate-bound HEK293, SA 293/GFP-hNaV1.7, and Millipore 293/hNaV1.7 cells, solutions of anti-NaV1.7 supernatants or control antibodies, at a fixed dilution of 1:20 in PBS+0.5% BSA were added as single points. For purified antibodies, serial dilutions ranging from 1.7 pM to 100 nM, and solutions without the presence of antibodies, were added in duplicate. The plates were incubated for 1 hour at RT then washed to remove unbound antibodies using an Aqua-Max2000 plate washer with a cell washing head (MDS Analytical Technologies, Sunnyvale, Calif.). The plate-bound antibodies were detected with a SULFO-TAG™-conjugated goat polyclonal anti-human IgG antibody specific for Fcγ fragment (Jackson Immunoresearch, West Grove, Pa.) for 1 hour at RT. Plates were washed and developed with Read Buffer (MSD, Rockville, Md.) according to the manufacturer's instructions, and luminescent signals were recorded with a SECTOR Imager (MSD, Rockville, Md.). Luminescence intensity, measured in relative light units (RLU), was recorded to indicate the binding intensity of each antibody at the range of concentrations.

For the primary screening of 3080 samples, supernatants with direct binding signals of greater than 300 RLU in SA 293/GFP-hNaV1.7 or Millipore 293/hNaV1.7 cell line were scored as positive. The 145 positive samples were further tested in all three cell lines with the procedure described above to determine specificity ratios. Antibodies with the binding ratio of greater than or equal to 2 on either human NaV1.7-expressing cells as compared to the HEK293 cells were classified as NaV1.7-specific binders and the tallied numbers are indicated in Table 6.

For the purified antibodies, the ratio of binding signal detected at 1.2 nM of antibody on human NaV1.7 expressing cells compared to the same concentration of antibody binding to HEK293 cells are shown in Table 7 and are used as an indication of specificity of NaV1.7 binding. Antibodies with a binding signal of >150 RLU on SA 293/GFP-hNaV1.7 or Millipore 293/hNaV1.7 cells and a ratio of greater than or equal to 2 as compared to the HEK293 cells were classified as NaV1.7-specific binders. Antibodies with the binding ratio less than 2 or a binding signal <150 RLU were classified as non-specific binders.

Results Summary and Conclusions

Three spleens from NaV1.7 immunized human NaV1.2 KI into mNaV1.7 KO VI mice were fused to generate hybridomas. Supernatants from those cells were evaluated for human NaV1.7 cell binding and specificity using electrochemiluminescence (ECL). Antibodies were bound to the human NaV1.7-expressing cells, 293/GFP-hNaV1.7 or Millipore 293/hNaV1.7, and, in some experiments, a reference cell line, HEK293, and detected with a SULFO-TAG™-conjugated anti-mouse IgG polyclonal antibody.

As the results in Table 6 show, 3080 hybridomas supernatants were tested at a 1:20 dilution and 145 bound to SA 293/GFP-hNaV1.7 and/or Millipore 293/hNaV1.7 cells with a signal greater than or equal to 300 RLU as detected by ECU All three fusions yielded NaV1.7 positive cell binders. The 145 supernatants were subsequently tested for binding to the two NaV1.7 cell lines along with the reference HEK293 cells. 60 of the positive hybridomas bound specifically to NaV1.7 cells with ratios of >2 fold binding to SA 293/GFP-hNaV1.7 or Millipore 293/hNaV1.7 cells relative to HEK293 cells. 52 of those 60 supernatants bound specifically to both cell lines. Two of three fusions yielded NaV1.7-specific hybridomas as determined by ECL.

A subset of 24 of the 60 hybridomas were single cell sorted by flow cytometry, expanded, and the antibodies purified and assessed for NaV1.7 cell specific binding in one of two binding experiments. In Table 7, the ratios of 1.2 nM of antibodies binding to SA 293/GFP-hNaV1.7 and Millipore 293/hNaV1.7 cells as compared to HEK293 cells were reported. 20 of the 24 antibodies bound specifically to both NaV1.7 cell lines, with binding on SA 293/GFP-hNaV1.7 ranging from 2.4 to 57.9 fold higher than binding on HEK293 cells and binding on Millipore 293/hNaV1.7 cells ranging from 2.5-44.5 fold higher than binding on HEK293 cells. Four of the 24 antibodies were non-specific with binding signals <150 RLU, and/or binding ratios less than two on the NaV1.7 cells vs reference cells. The positive NaV1.7 control antibody previously isolated had an average of 23.5 fold higher binding on SA 293/GFP-hNaV1.7 than on HEK293 cells and an average of 17.3 higher binding on Millipore 293/hNaV1.7 cells than on HEK293 cells. The isotype control antibodies had binding <150 RLU and close to equal binding on all cells as expected.

TABLE 6

Hybridoma Supernatant Primary Screening Summary

| Fusion ID | # of Wells Screened by ECL on SA 293/GFP-hNaV1.7 and Millipore 293/hNaV1.7 | # of Positives Binding >300 RLU on either NaV1.7 Cells | # Specific-Cell Binding Ratio >2 on SA 293/GFP-hNaV1.7 and/or Millipore Cells Relative to HEK293 | # Specific Cell Binding Ratio >2 on Both NaV1.7 Cells Relative to HEK293 |
|---|---|---|---|---|
| 1 | 968 | 15 | 10 | 9 |
| 2 | 968 | 9 | 0 | 0 |
| 3 | 1144 | 121 | 50 | 43 |
| Total | 3080 | 145 | 60 | 52 |

TABLE 7

| Hybridoma/Antibody Designation | Ratio Bound SA 293/GFP-hNaV1.7 to HEK293 at 1.2 nM Ab | Ratio Bound Millipore 293/hNaV1.7 to HEK293 at 1.2 nM Ab |
|---|---|---|
| A | 10.8 | 11.0 |
| B | 15.3 | 15.2 |
| C | 6.0 | 5.1 |
| D | 8.2 | 11.0 |
| E | 6.8 | 10.1 |
| F | 3.4 | 3.9 |
| G | 10.4 | 14.8 |
| H | 2.4 | 3.4 |
| I | 2.5 | 3.1 |
| J | 1.1 | 1.8 |
| K | 5.3 | 6.8 |
| L | 5.9 | 7.3 |
| M | 3.5 | 5.9 |
| N | 4.5 | 7.5 |
| O | 1.1 | 1.7 |
| P | 1.2 | 0.9 |
| Q | 38.4 | 26.1 |
| R | 2.3 | 1.3 |
| S | 9.5 | 16.1 |
| T | 9.0 | 17.6 |
| U | 57.9 | 44.5 |
| V | 2.9 | 2.5 |
| W | 46.0 | 28.3 |
| X | 20.9 | 14.9 |
| An anti-human NaV1.7 positive control antibody | 23.5 | 17.3 |
| mIgG1 control | 1.1 | 1.1 |
| mIgG2a control | 1.5 | 1.5 |

Example 4

Selected anti-Nav1.7 hybridoma clones were collected and total RNA was isolated using Promega Maxwell® 16 system. Next, reverse transcription was performed to generate cDNA containing human variable domain with a part of the mouse constant region sequences using SMARTscribe™ Reverse Transcriptase (Clontech) and reverse primers specific to mouse constant region of the mouse of the heavy chain IgG1, IgG2a, IgG2b, IgG3 and mouse kappa light chain together with the template switching oligo, SMARTer II A oligo (Trombetta et at 2014, PMID: 24984854, incorporated herein by reference in its entirety). cDNAs and subsequent PCR products were purified using Agencourt® Ampure XP beads (Beckman Coulter Genomics). Purified cDNAs were then amplified by PCR using a primer specific to SMARTer II A oligo with illumina adapter sequences (5'-TCGTCGGCAGCGTCA-GATGTGTATAAGAGACAG-3', SEQ ID NO: 57) and reverse primers specific to mouse constant region with Illumina adapter sequences (5'-GTCTCGTGGGCTCG-GAGATGTGTATAAGAGACAG-3', SEQ ID NO: 58). The fragments were further amplified by PCR using primers with index sequences for multiplex sequencing. PCR products were purified, processed and pooled to be analyzed by Miseq sequencer (Illumina) for sequencing.

Table 8 shows V gene usage in anti-NaV1.7 monoclonal antibodies compared to V gene usage in the VelocImmune mouse, which is described in U.S. Pat. Nos. 8,502,018 and 8,642,835, incorporated herein by reference in their entireties.

TABLE 8

| VelocImmune Mouse (VI) | |
|---|---|
| Light Chain Segment | Usage |
| IGKV1-17 | +++ |
| Heavy Chain Segment | Usage |
| IGHV3-15 | + |
| IGHV3-30 | ++ |
| Anti-NAV1.7 Hybridoma Clones | |
| Light Chain Segment | Usage |
| IGKV3-20 | + |
| IGKV2-40 | + |
| IGKV2-30 | +++ |
| IGKV2-28 | +++++ |
| IGKV2-24 | ++ |
| IGKV1-5 | ++++ |
| IGKV1-39 | ++ |
| IGKV1-33 | + |
| IGKV1-17 | None |
| IGKV1-16 | +++ |
| Heavy Chain Segment | Usage |
| IGHV1-18 | + |
| IGHV1-69 | + |
| IGHV2-26 | None |
| IGHV2-70 | None |
| IGHV3-15 | +++++ |
| IGHV3-23 | ++ |
| IGHV3-30 | ++ |
| IGHV3-33 | +++ |

TABLE 8-continued

| | |
|---|---|
| IGIIV3-64 | + |
| IGHV3-7 | + |
| IGHIV3-73 | +++ |
| IGHV4-39 | + |
| IGHV4-59 | + |
| IGHV6-1 | ++ |

Example 5. Human NaV1.2 KI into mNaV1.7 KO VI Mice have an Impaired Response to Thermal Stimuli and Reduced Itch Response to Histamine Methods Hot plate—Mice were placed on a hot plate device (IITC, Woodland Hills, Calif.). The latency to jump, lift and/or lick a hindpaw was recorded at 52.5° C. or 55° C. (the 2 different temperatures were tested 10 days apart).

Hargreaves—Thermal hyperalgesia was measured using the Hargreaves apparatus (IITC, Woodland Hills, Calif.). Mice were placed in plexiglas chambers at least 60 minutes before testing. Thermal latency to respond to the radiant heat stimulus applied to the left hindpaw was recorded 3 times during the test session and an overall mean latency measurement was used.

Itch—Mice were habituated to Plexiglas chambers for at least 15 minutes prior to testing. Mice were injected intradermally with 150 µg histamine Dihydrochloride (15 µl in PBS, Sigma, cat #1309009) between the shoulder blades in the nape of the neck. Video cameras (Noldus) oriented upwards to view the bottom of the chambers recorded activity for up to 25 minutes post-injection. Video files were scored manually for total scratching bouts post-histamine injection.

Results

Figures 7A, 7B:
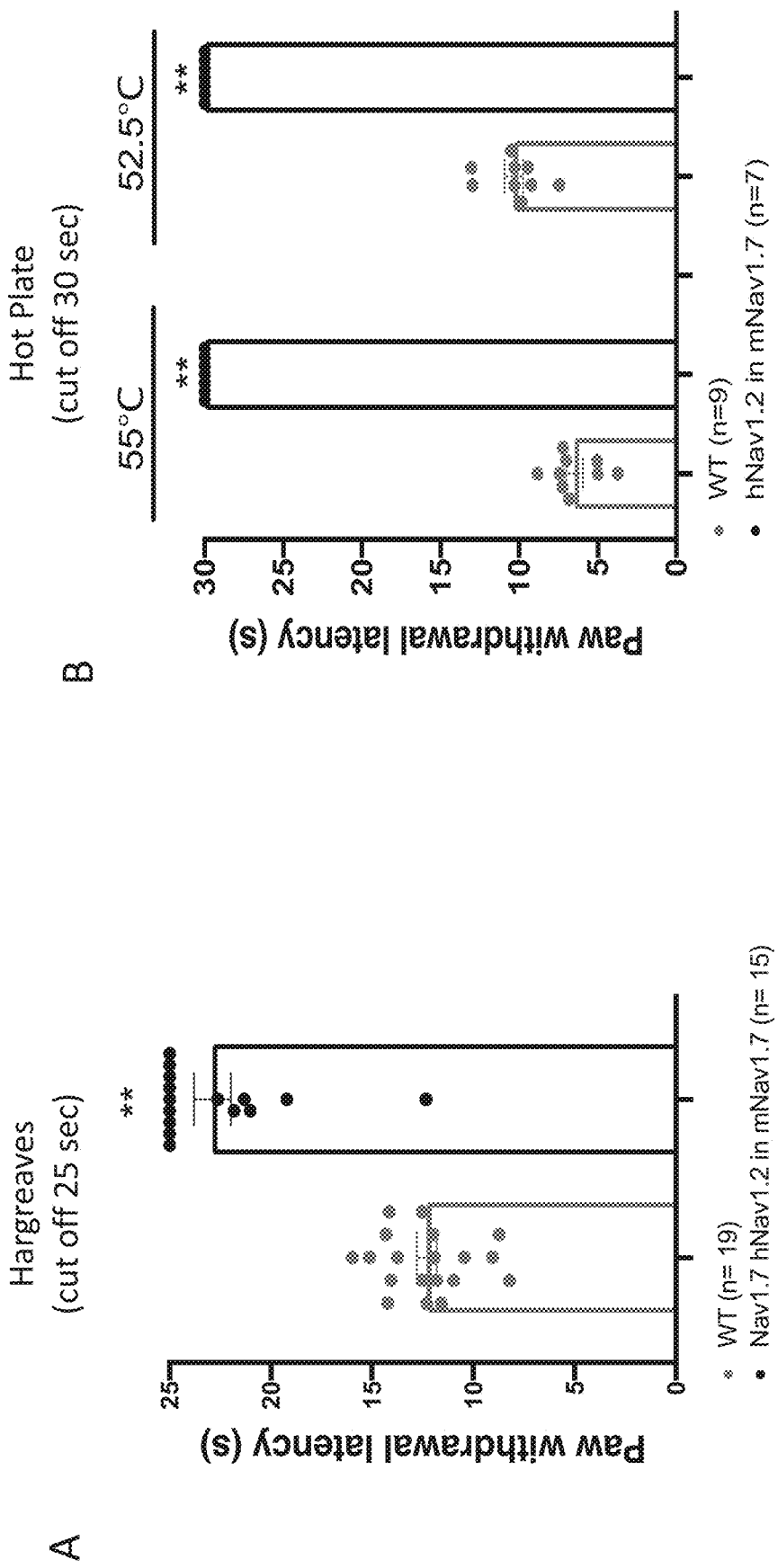
FIGS. 7A-7C. hNaV1.2 KI into mNaV1.7 KO/VI-3 mice have an impaired response to thermal stimuli and a significantly reduced itch response to histamine. 7A, hNaV1.2 KI into mNaV1.7 KO/VI-3 mice show a significantly prolonged latency to respond to the heat stimulus (Hargreaves, 22.9±0.9 s, n=15 for hNAV1.2 KI into mNaV1.7 KO/VI-3 mice versus 12.3±0.5 s, n=19 for WT mice, unpaired Student's t test, p<0.0001). 7B, Paw withdrawal latency in the hot plate test. The hNaV1.2 KI into mNaV1.7 KO/VI-3 mice did not respond to the 52.5 or 55° C. thermal stimulus and were removed from the hot plate at the pre-determined cut off time of 30 seconds to avoid tissue damage. On the other hand, WT mice quickly displayed nocifensive behaviors in response to the heat stimuli (55° C. 6.5±0.5 s, n=9 for WT and 30 s, n=7 for hNaV1.2 KI into mNaV1.7 KO/VI-3 mice; 52.5° C.: 10.4±0.6 s for WT and 30 s, n=7 for hNaV1.2 KI into mNaV1.7 KO/VI-3 mice; p<0.0001). 7C, Total number of scratching bouts following intradermal injection of 150 µg histamine in the nape of the neck. hNaV1.2 K1 into mNaV1.7 KO/VI-3 mice displayed 3.7 fold-less scratching bouts than WT mice (24±11 bouts for hNaV1.2 KI into mNaV1.7 KO/VI-3 mice vs 81±20 bouts for WT, unpaired Student's T test p=0.047).

The hNav1.2 KI into mNav1.7 KO mice, described in Example 1, were tested for their response to acute thermal stimuli. First, the mice were tested for their withdrawal latency to a radiant heat stimulus directed to the hindpaw, also known as the Hargreaves test. The hNav1.2 into mouse Nav1.7 mice showed a significantly prolonged latency to respond to the heat stimulus ($22.9 \pm 0.9$ s, n=15 for hNav1.2 into mouse Nav1.7 mice versus $12.3 \pm 0.5$ s, n=19 for WT mice, unpaired Student's t test, $p<0.0001$), see FIG. 7A. Next, the mice were tested on a hot plate apparatus at 2 noxious temperatures, 52.5° C. and 55° C. (the 2 temperatures were tested 10 days apart). The mice expressing hNav1.2 into mouse Nav1.7 did not respond at either temperature; all mice reached the cut off time of 30 seconds at which point the test was stopped to prevent tissue damage, while the WT mice quickly displayed nocifensive responses at both temperature ($6.5 \pm 0.5$ s, n=9 at 5.5° C. and $10.4 \pm 0.6$ s at 52.5° C.); see FIG. 7B.

Figure 7C:
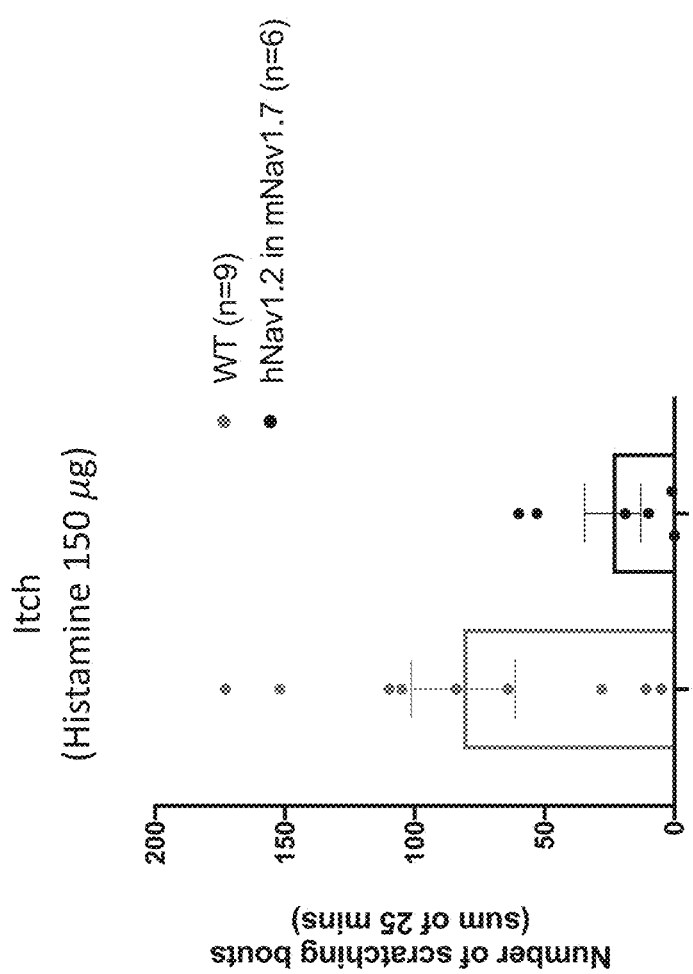

To test if mice expressing hNav1.2 mice into mouse Nav1.7 locus had an impaired itch response to pruritogen, histamine (15 µg) was injected intradermally in the nape of the neck of mice and scratching bouts were recorded for up to 25 minutes. hNav1.2 in mNav1.7 mice displayed 3.7 fold-less scratching bouts than WT mice ($24 \pm 11$ bouts for hNav1.2 in mNav1.7 mice vs $81 \pm 20$ bouts for WT, unpaired Student's t test $p=0.047$); see FIG. 7C.

Various publications, including patents, patent applications, published patent applications, accession numbers, technical articles and scholarly articles are cited throughout the specification. Each of these cited publications is incorporated by reference, in its entirety and for all purposes, in this document.

SEQUENCE LISTING (58 sequences)

SEQ ID NO: 1 - DNA, 9865 bp, Mus musculus
gcacacaccccacccagagaggtggccgcgggtgagaggctgtgcgacccacctcctgtcccttcttctagcacggagtatagaggctgccgcatccctagcatcaccacgcccaatcgccaggtctccgccctgcaccgtctaccgggctgggaggagggagctaggggtggggacccgagagctcagggagcatcgaggaggcctagcgacgcggttggcagccgagggcggggtcgcttcatcctgagcagactagaaacagacagactccgtgcaggcctagcctgcgctccaattgcgactctagccttttcaatcctgcccactgtgcaggctggtctggtctagcctgggtatcccggactcctagtagcaggcactgtgagcaacaggatttcaaagaaagaagcagagggaagaaagaagcctgggaagagaggaagacttcccttggatcagaatccgcaggtgcactcaccgggtgggcatgatccgtggggccaggcctcttaggtaaggatccgaaggggaaataaaacctacaggatgagaagatggcgatgttgcctccgccaggacctcagagcttcgttcacttcacaaaacagtcccttgccctcattgaacaacgcatttctgaagaaaaagccaagggacacaaagatgaaaagaaagatgatgaggaagaaggtcccaagcccagtagtgacttggaagcaggtaaacagctacccttcatctacggagacattcccccgggaatggtgtcagagcccctggaggacctggacccatactatgcagacaaaaaaacttttatagtattgaacaaagggaaagcaatcttccgtttcaacgccacccctgctttgtacatgctgtctcccttcagtcctctcagaagaatatctattaagattttagtgcactccttattcagcatgctaatcatgtgcacaattctgacaaactgcatattcatgaccatgagcaaccctccagattggaccaaaaacgtagagtacacttttactgggatatatacttttgaatcactcataaaaatccttgcaagaggcttttgcgtgggcgaattcaccttcctccgtgacccttggaactggctggactttgttgtcattgtttttgcgtatttaacagaatttgtaaacctaggcaatgtttcagctcttcgaactttcagagtcttgagagctttgaaaactatttctgtaattccaggactaaaaaccatcgtgggggccctgatccaatcagtgaagaagctctctgacgtcatgatcctcactgtgttctgtctcagtgtgttcgcactaattggactacaactgtttatgggcaacttgaagcataaatgtttccggaaggaccttgagcagaatgaaacattagaaagcatcatgagtactgctgagagtgaagaagaattgaaaagatatttttattacttggagggatccaaagatgctcttctttgcggtttcagcacagattcagggcagtgtcctgaagggtacgagtgtgtgacagctggcagaaacccagattatggctacacaagctttgacacgttcggctgggccttcttggccttgtttcggctaatgactcaggactactgggagaacctttatcaacagacactgcgtgctgctggcaaaacctacatgattttctttgtcgtggtgatatttctgggatccttttacctgataaacttgatcctggctgtggtagccatggcgtacgaggaacagaaccaggccaacatcgaagaagctaaacagaaagagttagaatttcagcagatgttagaccgactcaaaaaagagcaggaagaagccgaggcgatcgctgcagccgctgctgagtacacgagtttagggcggagcaggattatgggactctctgagagctcttcagaaacctccaggctgagctcaaagagtgccaaggagagaagaaaccgaagaaagaaaaaaaaacagaagctgtccagtggcgaggaaaagggtgatgatgagaagctgtccaagtcagggtcagaggaaagcatccgaaagaaaagcttccatctcggcgtggaagggcaccaccgggccagggaaaagaggctgtccacccccaaccagtcaccactcagcattcgtgggtccttgttttctgccaggcgcagcagcagaacaagtctcttcagttttaaggggcgaggaagagatctgggatctgaaacggaatttgctgatgatgagcatagcatttttggagacaacgagagcagaaggggttcactatttgtaccccatagaccccgggagcggcgcagcagtaacatcagccaggccagtaggtccccaccagtgctgccggtgaacgggaagatgcacagtgcagtggactgcaatggcgtggtgtcgcttgttgatggaccctcagccctcatgctccccaatggacagcttcttccagaggtgataatagataaggcaacttccgacgacagcggcacaactaatcagatgcgtaaaaaaaggctctctagttcttactttttgtctgaggacatgctgaatgacccacatctcaggcaaagggccatgagcagagcaagcattctaaccaacacagtagaagaacttgaagaatctagacaaaaatgtccaccatggtggtacagatttgctcacacatttttaatctggaattgttctccatattggataaaattcaaaaagttcatctattttattgtaatggatccttttgtagatcttgcaattaccatttgcatagttttaaacaccttgtttatggctatggagcaccatccaatgacggatgaattcaaaaatgtacttgcagtcgggaacctggtcttcacagggatcttcgcagctgaaatggtactgaagttaatagccatggatccctatgaatatttccaagtagggtggaatatttttgacagcctgattgtgacgttgagtttggtggagcttttcctagcagatgtggaaggattatcagtcctgcggtcctttagattgctgcgagtcttcaagttggcaaaatcctggcccacactgaatatgctcattaagatcatcggcaactcggtgggcgcactgggcaacctgaccctggtgctggccatcatcgtcttcatttttgccgtggtcggcatgcagctgtttggaaagagctacaaggagtgtgtttgcaagatcaacgagaactgcaagctcccacgctggcacatgaacgacttcttccactccttcctgatcgtgttccgtgtgctgtgtggggagtggatagagaccatgtgggactgcatggaggttgcgggccagaccatgtgccttattgtttacatgatggtcatggtgattgggaaccttgtggtcctgaacctgtttctggctttattactgagttcctttagttctgacaatcttacagcaattgaagaagacaccgacgcaaacaacctccagattgcagtggccagaattaaaagagggatcaattatgtgaaacagaccctgcgtgaattcattctaaagtcattttccaaaaagccaaagggctccaaggacacaaaacgaacagcggatcccaacaacaaaagagaaaactatatctcaaaccgtacccttgcggagataagcaaagatcacaatttcctcaaagaaaaggataagatcagtggttttagcagcagtctagacaaaagctttatggatgaaaacgattaccagtcctttattcataatcccagcctcacagtgacagtgcccattgcacctggggagtctgatttggagaatatgaacacagaagagcttagcagtgactcagatagtgactacagcaaagagagacggaaccgatcaagttcttcagagtgcagcacagttgataaccctctgccaggagaagaggaggcagaagctgagcctatcaatgcagatgagcccgaagcctgttttacagatggctgtgtgaggagatttccatgctgccaagttaacatagactccgggaaagggaaagtttggtggaccatccggaagacctgctacaggatagtggagcacagctggtttgaaagcttcattgttctcatgatcctgctcagcagtggagctctggcttttgaggatatatatattgaaaagaaaaagaccattaagattatcctggagtatgctgacaagatattcacctacatcttcattctggaaatgcttctaaaatgggtggcatacgggtataaaacatatttcactaatgcctggtgttggctggacttcttaattgttgatgtgtctctagttactttagtagccaacactcttggctactcagaccttggccccattaaatctctacggacactgagggccctaagacccctaagagctttgtctagatttgaaggaatgagggtagtggtcaacgcactcataggagcaatcccttccatcatgaatgtgcttcttgtgtgccttatattctggctaatatttagcatcatgggagtcaatctgtttgctggcaagttctatgagtgtgttaacaccacagatggctcacgattttctgtatctcaagttgcaaaccgttctgagtgttttgccctgatgaatgttagtggaaatgtgcgatggaaaaacctgaaagtaaacttcgataacgttggacttggttacctgtcgctgcttcaagttgcaacgttcaagggctggatggatattatgtatgcagcagttgactctgttaatgtaaatgcacaaccaatatatgaatacaacctctacatgtacatttattttgtcatcttcatcatctttggctcattcttcactttgaacttgttcattggtgtcatcatcgataatttcaaccaacagaagaagaagcttggaggtcaagatatctttatgacagaagaacagaagaaatactataatgcaatgaagaagctggggtccaagaaaccacaaaaaccaattccgaggccagggaacaaattccaaggatgcatatttgacttagtgacaaaccaagcttttgatatcaccatcatggttcttatctgcctcaatatggtaaccatgatggtagaaaaagaggggcaaactgactacatgagttttgtgctatactggatcaacgtggtcttcatcatcctgttcactggggagtgtgtgctgaagctgatctctctcaggcattactacttcactgtgggatggaacatttttgattttgtggtagtgatcctctccattgtaggaatgtttctcgctgagatgatagagaagtatttcgtgtctcctaccctgttccgagtcattcgcctggccaggattggacgaatcctacgcctgatcaaaggcgccaaggggatccgcacgctgctctttgctctgatgatgtcccttcctgcgctgttcaacatcggcctcctgcttttcctcgtcatgttcatctacgccatctttgggatgtccaactttgcctacgttaaaaaggaagctggaattaatgacatgttcaactttgagaccttcggcaacagcatgatctgcctgttccaaatcaccacctctgcgggctgggatggactgctggcccccatcctcaacagtgcacctcctgactgtgacccaaaaaaggttcacccaggaagttcagtggaaggggactgtggaaatccatctgtgggaattttctactttgtcagctacatcatcatatccttcctggttgtggtgaacatgtacattgctgtcatcctggagaacttcagcgttgccacagaagaaagtactgagcccctgagtgaggacgactttgagatgttctacgaagtctgggagaagttcgaccctgacgccacccagttcatagagttctgcaagctctctgactttgcagcagccctggatcctcccctcctcatcgcaaagccaaacaaagtccagctcattgccatggacctgcccatggtgagtggagaccgcatccactgcctggacatcttatttgcttttacaaagcgggtcctgggcgagagcggagagatggattcccttcgttcacagatggaagaaaggtttatgtcagccaatccttctaaagtgtcctatgagcccatcacaaccacactgaagcgaaaacaagaggatgtatctgcgactatcattcagcgtgcttacagacggtaccgccttaggcaaaacgtcaagaatatatcaagtatatatataaaagatggagacagagatgacgatttgcccaataaagaagatatagtttttgataatgttaacgagaactcaagtccagaaaagacagatgcaacagcctctaccatctctccaccttcctatgacagtgtcacaaagccagatcaagagaaatatgaaacagacaaaacggagaaggaagacaaagagaaagacgaaagcaggaaatagagcttcggttttgatacactgtttacagcctgcgaaggtgactcactcgtgttaataagactcttttacggaggtctatgccaaactctttttatcaaatattctcaaaggcagcacagccactagctctgatccagtgaaacaagagagaagcatttacacatggctactttttgcgttggtcaatgattctttaagaattgtgcatgtaactctacagggaataatcattattgcaatcaagggtgacttaatgattttaaatatcagaaaaccacatagaacattttctcttttgcctccatttctttccctagattctaagtagatgtgtacccatgtgaatatagaaattcaggcgcacatgctcacagtcacaaacacaaacaggattagctgtgatttggaattcgatgtaaatatttcacctgtgatttgcaatgaaattccttgtaaaagaaatgcgaattagtgatgaaggttttgtgaaaacatcttatcattagggagtcagaatttctgtccataaagaattcagtttatattttgaggtgctgaaacttatcctacattgcatcaaaatcaatttataggtatctgtaaaatgtcatgggactgaaaaacatatataggctacttgtttaagaaatggctttcattcatatagataggcattcaccttgatttatggacatctttggcattttgtgatcacatgattcttccacaaaattgcttagctggaacttcaggcacacatcacagagaacagctacccagtcttatgcccctctctgtttgtacaataatcacagagcttgaaacattatttgaactataaatatcaggtttctccacatagacatatgaatattgttaacagaaaaaaattttatttacagcgttttatttactaatatttatccaatctagtttgcccaatgagacagctcatgactcacatctgaaagccagttgccacatttatcttcttatgtaactttggtttgtcatactttatgtctaagcaaattgaatgtctcctttctaatgagatgtaccctgaaatgcagttaggtacttgatactttagcgcttgtttgagcagatgactggagcacagtgtggactgcatctcttaaatacaatccttaatgtgtttggcagcttctcaggttacaaggaacacccggcttttagtgtctatctgttcaccaggtgtttagtatgaatgaaacggcattcaaagagtgagtctcactggcttgctttattactgatgccttccctatggagaattaatcctctgaagccccattatgtccccctgtaaataatgtagatgtcacttccttcttaatattctaatccatactgtgaaatcgattttgcatttatcggtcaaatagagcattttgagatagttggagttaccctgccaaggattagaaatctacttcatgtttttaaagtacttgttaaaaatgaacgaccctggcacattctctcataattttattccagccatgtgaaatctttcttctaaacactttatccttgcggaggaaaaaaaaaatgagctgatgagccatttaagcacaaaggggctttatttagaagattccaagggggaactttgaagtaaatatataaaacatacttcatcaatttgcctataaaactaaaagaggaacacaggaatattgataaaataagtcattaaaacacattctttatttcttgcccagtttaaaagaaagaactaaacatccctagagagaggaagagacatagagagagagtgactaatagaaagagggagagaagaaacaaggcaccaaggacaaaaagagataattagacagaacttgtccaggttttcacactatgtgctctgtccagtaccgtacacaagaacctctttccaaatatttgtcctaaggctctaagaagttaagtacgaggctgaaggttgaatacaactgtctttaatcattaacagtttggggagctacttttaaacgtctatggaagatgccaagcagtggtaagccagacaatacagagcactgcatatctgtcaagcagctgaaatatgtttgggcaacttaatggtgagccacacaaaacatccatttgtaacaattttaatacattcaattaagaaaccaggatttttattattttgcacccataaaaatataactatattgttcatttttattgatagagtatgtgtgaatcttattgattatctgtaatttactattaatgtttttacagtgactgttttttttgtgtgtgtaaacttaatatatgtcagcaactggttcctcaacacaattttttttagcattacaaaaaaatgaacaggtataaaggttctcttttttctacatcatgttgaacatattttgttctgaattacatagttttaaatgtaatattaagttttatattcatatatgtttaacatcaaaatcactacttatgacattgttatcaatttaaaaaatagtatttgacactaggatagcatttaattaaagctaaaaagcttacaccccatttcatgttgattagtgtttggactaactctaaaatgtcatcaatggaagctagtcactgaaattattttatctattgtcatagaatggtgactacccaaaaaatataagttagcattaaatagaagaaagcgtacgtgaccacaaatccatgcacagggttgtgtgaagacaggagaacctcatttttctgttttgtctctttccactgtgtaaaaagtctacatctgtgggctatttctaaattcaaattgtcacaatttgcaatcataaatgtttagcatactttgtagaattttgatagttttgtaaaagagtgaaaaacaaatgcatatgtaaataaagcagcccatactagcagattcctcaaatgttaatatgtaaataaagcagcccttactagcagattcatcaaatgttaatatgtaaataaagcagtccttattagcagatttgtcatatgttaaggggagtaatgataaggaggcaactaaatcaggatggtcagtaactgatctgggtttagaactgtgtttggagccatcaatttttaaatatatgttctcactatgttattagttgtctgaagaagcaatcaagaattgctcccagaaaatgagtaagtagccatgaatatatgaatgctgtttacagaacccatagacctatgaatgctcaaaatgtttgggtttgtcaaaaaattacattgtagttatacttgatacttaaaaactgttaatagagtctaaaataaaagtcgctaaaattaaaaaaaaaaaaaaaaaa

SEQ ID NO: 2 - protein, 1984 aa, Mus musculus
MAMLPPPGPQSFVHFTKQSLALIEQRISEEKAKGHKDEKKDDEEEGPKPSSDLEAGKQLPFIYGDIPPGMVSEPLEDLDPYYADKKTFIVLNKGKAIFRFNATPALYMLSPFSPLRRISIKILVHSLFSMLIMCTILTNCIFMTMSNPPDWTKNVEYTFTGIYTFESLIKILARGFCVGEFTFLRDPWNWLDFVVIVFAYLTEFVNLGNVSALRTFRVLRALKTISVIPGLKTIVGALIQSVKKLSDVMILTVFCLSVFALIGLQLFMGNLKHKCFRKDLEQNETLESIMSTAESEEELKRYFYYLEGSKDALLCGFSTDSGQCPEGYECVTAGRNPDYGYTSFDTFGWAFLALFRLMTQDYWENLYQQTLRAAGKTYMIFFVVVIFLGSFYLINLILAVVAMAYEEQNQANIEEAKQKELEFQQMLDRLKKEQEEAEAIAAAAAEYTSLGRSRIMGLSESSSETSRLSSKSAKERRNRRKKKKQKLSSGEEKGDDEKLSKSGSEESIRKKSFHLGVEGHHRAREKRLSTPNQSPLSIRGSLFSARRSSRTSLFSFKGRGRDLGSETEFADDEHSIFGDNESRRGSLFVPHRPRERRSSNISQASRSPPVLPVNGKMHSAVDCNGVVSLVDGPSALMLPNGQLLPEVIIDKATSDDSGTTNQMRKKRLSSSYFLSEDMLNDPHLRQRAMSRASILTNTVEELEESRQKCPPWWYRFAHTFLIWNCSPYWIKFKKFIYFIVMDPFVDLAITICIVLNTLFMAMEHHPMTDEFKNVLAVGNLVFTGIFAAEMVLKLIAMDPYEYFQVGWNIFDSLIVTLSLVELFLADVEGLSVLRSFRLLRVFKLAKSWPTLNMLIKIIGNSVGALGNLTLVLAIIVFIFAVVGMQLFGKSYKECVCKINENCKLPRWHMNDFFHSFLIVFRVLCGEWIETMWDCMEVAGQTMCLIVYMMVMVIGNLVVLNLFLALLLSSFSSDNLTAIEEDTDANNLQIAVARIKRGINYVKQTLREFILKSFSKKPKGSKDTKRTADPNNKRENYISNRTLAEISKDHNFLKEKDKISGFSSSLDKSFMDENDYQSFIHNPSLTVTVPIAPGESDLENMNTEELSSDSDSDYSKERRNRSSSSECSTVDNPLPGEEEAEAEPINADEPEACFTDGCVRRFPCCQVNIDSGKGKVWWTIRKTCYRIVEHSWFESFIVLMILLSSGALAFEDIYIEKKKTIKIILEYADKIFTYIFILEMLLKWVAYGYKTYFTNAWCWLDFLIVDVSLVTLVANTLGYSDLGPIKSLRTLRALRPLRALSRFEGMRVVVNALIGAIPSIMNVLLVCLIFWLIFSIMGVNLFAGKFYECVNTTDGSRFSVSQVANRSECFALMNVSGNVRWKNLKVNFDNVGLGYLSLLQVATFKGWMDIMYAAVDSVNVNAQPIYEYNLYMYIYFVIFIIFGSFFTLNLFIGVIIDNFNQQKKKLGGQDIFMTEEQKKYYNAMKKLGSKKPQKPIPRPGNKFQGCIFDLVTNQAFDITIMVLICLNMVTMMVEKEGQTDYMSFVLYWINVVFIILFTGECVLKLISLRHYYFTVGWNIFDFVVVILSIVGMFLAEMIEKYFVSPTLFRVIRLARIGRILRLIKGAKGIRTLLFALMMSLPALFNIGLLLFLVMFIYAIFGMSNFAYVKKEAGINDMFNFETFGNSMICLFQITTSAGWDGLLAPILNSAPPDCDPKKVHPGSSVEGDCGNPSVGIFYFVSYIIISFLVVVNMYIAVILENFSVATEESTEPLSEDDFEMFYEVWEKFDPDATQFIEFCKLSDFAAALDPPLLIAKPNKVQLIAMDLPMVSGDRIHCLDILFAFTKRVLGESGEMDSLRSQMEERFMSANPSKVSYEPITTTLKRKQEDVSATIIQRAYRRYRLRQNVKNISSIYIKDGDRDDDLPNKEDIVFDNVNENSSPEKTDATASTISPPSYDSVTKPDQEKYETDKTEKEDKEKDESRK

SEQ ID NO: 3 - DNA, 8876 bp, Homo sapiens
ggctgcttcagacatatgtctgtgtgtacgctgtgaaggtgtttctcttcacagttccccgccctctagtggtagttacaataatgccattttgtagtccctgtacaggaaatgcctcttcttacttcagttaccagaatccttttacaggaagttaggtgtggtctttgaaggagaattaaaaaaaaaaaaaaaaaaaaaaaaaaaagatttttttttttttaaagcatgatggaattttagctgcagtcttcttggtgccagcttatcaatcccaaactctgggtgtaaaagattctacagggcactttcttatgcaaggagctaaacagtgattaaaggagcaggatgaaaagatggcacagtcagtgctggtaccgccaggacctgacagcttccgcttctttaccagggaatcccttgctgctattgaacaacgcattgcagaagagaaagctaagagacccaaacaggaacgcaaggatgaggatgatgaaaatggcccaaagccaaacagtgacttggaagcaggaaaatctcttccatttatttatggagacattcctccagagatggtgtcagtgcccctggaggatctggacccctactatatcaataagaaaacgtttatagtattgaataaagggaaagcaatctctcgattcagtgccacccctgccctttacattttaactcccttcaaccctattagaaaattagctattaagattttggtacattctttattcaatatgctcattatgtgcacgattcttaccaactgtgtatttatgaccatgagtaaccctccagactggacaaagaatgtggagtatacctttacaggaatttatacttttgaatcacttattaaaatacttgcaaggggcttttgtttagaagatttcacatttttacgggatccatggaattggttggatttcacagtcattacttttgcatatgtgacagagtttgtggacctgggcaatgtctcagcgttgagaacattcagagttctccgagcattgaaaacaatttcagtcattccaggcctgaagaccattgtgggggccctgatccagtcagtgaagaagctttctgatgtcatgatcttgactgtgttctgtctaagcgtgtttgcgctaataggattgcagttgttcatgggcaacctacgaaataaatgtttgcaatggcctccagataattcttcctttgaaataaatatcacttccttctttaacaattcattggatgggaatggtactactttcaataggacagtgagcatatttaactgggatgaatatattgaggataaaagtcacttttattttttagaggggcaaaatgatgctctgctttgtggcaacagctcagatgcaggccagtgtcctgaaggatacatctgtgtgaaggctggtagaaaccccaactatggctacacgagctttgacacctttagttgggcctttttgtccttatttcgtctcatgactcaagacttctgggaaaacctttatcaactgacactacgtgctgctgggaaaacgtacatgatattttttgtgctggtcattttcttgggctcattctatctaataaatttgatcttggctgtggtggccatggcctatgaggaacagaatcaggccacattggaagaggctgaacagaaggaagctgaatttcagcagatgctcgaacagttgaaaaagcaacaagaagaagctcaggcggcagctgcagccgcatctgctgaatcaagagacttcagtggtgctggtgggataggagttttttcagagagttcttcagtagcatctaagttgagctccaaaagtgaaaaagagctgaaaaacagaagaaagaaaaagaaacagaaagaacagtctggagaagaagagaaaaatgacagagtccgaaaatcggaatctgaagacagcataagaagaaaaggtttccgtttttccttggaaggaagtaggctgacatatgaaaagagattttcttctccacaccagtccttactgagcatccgtggctcccttttctctccaagacgcaacagtagggcgagccttttcagcttcagaggtcgagcaaaggacattggctctgagaatgactttgctgatgatgagcacagcacctttgaggacaatgacagccgaagagactctctgttcgtgccgcacagacatggagaacggcgccacagcaatgtcagccaggccagccgtgcctccagggtgctccccatcctgcccatgaatgggaagatgcatagcgctgtggactgcaatggtgtggtctccctggtcgggggcccttctaccctcacatctgctgggcagctcctaccagagggcacaactactgaaacagaaataagaaagagacggtccagttcttatcatgtttccatggatttattggaagatcctacatcaaggcaaagagcaatgagtatagccagtattttgaccaacaccatggaagaacttgaagaatccagacagaaatgcccaccatgctggtataaatttgctaatatgtgtttgatttgggactgttgtaaaccatggttaaaggtgaaacaccttgtcaacctggttgtaatggacccatttgttgacctggccatcaccatctgcattgtcttaaatacactcttcatggctatggagcactatcccatgacggagcagttcagcagtgtactgtctgttggaaacctggtcttcacagggatcttcacagcagaaatgtttctcaagataattgccatggatccatattattactttcaagaaggctggaatatttttgatggttttattgtgagccttagtttaatggaacttggtttggcaaatgtggaaggattgtcagttctccgatcattccggctgctccgagttttcaagttggcaaaatcttggccaactctaaatatgctaattaagatcattggcaattctgtgggggctctaggaaacctcaccttggtattggccatcatcgtcttcatttttgctgtggtcggcatgcagctctttggtaagagctacaaagaatgtgtctgcaagatttccaatgattgtgaactcccacgctggcacatgcatgactttttccactccttcctgatcgtgttccgcgtgctgtgtggagagtggatagagaccatgtgggactgtatggaggtcgctggccaaaccatgtgccttactgtcttcatgatggtcatggtgattggaaatctagtggttctgaacctcttcttggccttgcttttgagttccttcagttctgacaatcttgctgccactgatgatgataacgaaatgaataatctccagattgctgtgggaaggatgcagaaaggaatcgattttgttaaaagaaaaatacgtgaatttattcagaaagcctttgttaggaagcagaaagctttagatgaaattaaaccgcttgaagatctaaataataaaaaagacagctgtatttccaaccataccaccatagaaataggcaaagacctcaattatctcaaagacggaaatggaactactagtggcataggcagcagtgtagaaaaatatgtcgtggatgaaagtgattacatgtcatttataaacaaccctagcctcactgtgacagtaccaattgctgttggagaatctgactttgaaaatttaaatactgaagaattcagcagcgagtcagatatggaggaaagcaaagagaagctaaatgcaactagttcatctgaaggcagcacggttgatattggagctcccgccgagggagaacagcctgaggttgaacctgaggaatcccttgaacctgaagcctgttttacagaagactgtgtacggaagttcaagtgttgtcagataagcatagaagaaggcaaagggaaactctggtggaatttgaggaaaacatgctataagatagtggagcacaattggttcgaaaccttcattgtcttcatgattctgctgagcagtggggctctggcctttgaagatatatacattgagcagcgaaaaaccattaagaccatgttagaatatgctgacaaggttttcacttacatattcattctggaaatgctgctaaagtgggttgcatatggttttcaagtgtattttaccaatgcctggtgctggctagacttcctgattgttgatgtctcactggttagcttaactgcaaatgccttgggttactcagaacttggtgccatcaaatccctcagaacactaagagctctgaggccactgagagctttgtcccggtttgaaggaatgagggttgttgtaaatgctcttttaggagccattccatctatcatgaatgtacttctggtttgtctgatcttttggctaatattcagtatcatgggagtgaatctctttgctggcaagttttaccattgtattaattacaccactggagagatgtttgatgtaagcgtggtcaacaactacagtgagtgcaaagctctcattgagagcaatcaaactgccaggtggaaaaatgtgaaagtaaactttgataacgtaggacttggatatctgtctctacttcaagtagccacgtttaagggatggatggatattatgtatgcagctgttgattcacgaaatgtagaattacaacccaagtatgaagacaacctgtacatgtatctttattttgtcatctttattatttttggttcattctttaccttgaatcttttcattggtgtcatcatagataacttcaaccaacagaaaaagaagtttggaggtcaagacatttttatgacagaagaacagaagaaatactacaatgcaatgaaaaaactgggttcaaagaaaccacaaaaacccatacctcgacctgctaacaaattccaaggaatggtctttgattttgtaaccaaacaagtctttgatatcagcatcatgatcctcatctgccttaacatggtcaccatgatggtggaaaccgatgaccagagtcaagaaatgacaaacattctgtactggattaatctggtgtttattgttctgttcactggagaatgtgtgctgaaactgatctctcttcgttactactatttcactattggatggaatatttttgattttgtggtggtcattctctccattgtaggaatgtttctggctgaactgatagaaaagtattttgtgtcccctaccctgttccgagtgatccgtcttgccaggattggccgaatcctacgtctgatcaaaggagcaaaggggatccgcacgctgctctttgctttgatgatgtcccttcctgcgttgtttaacatcggcctccttcttttcctggtcatgttcatctacgccatctttgggatgtccaattttgcctatgttaagagggaagttgggatcgatgacatgttcaactttgagacctttggcaacagcatgatctgcctgttccaaattacaacctctgctggctgggatggattgctagcacctattcttaatagtggacctccagactgtgaccctgacaaagatcaccctggaagctcagttaaaggagactgtgggaacccatctgttgggattttcttttttgtcagttacatcatcatatccttcctggttgtggtgaacatgtacatcgcggtcatcctggagaacttcagtgttgctactgaagaaagtgcagagcctctgagtgaggatgactttgagatgttctatgaggtttgggagaagtttgatcccgatgcgacccagtttatagagtttgccaaactttctgattttgcagatgccctggatcctcctcttctcatagcaaaacccaacaaagtccagctcattgccatggatctgcccatggtgagtggtgaccggatccactgtcttgacatcttatttgcttttacaaagcgtgttttgggtgagagtggagagatggatgcccttcgaatacagatggaagagcgattcatggcatcaaacccctccaaagtctcttatgagcccattacgaccacgttgaaacgcaaacaagaggaggtgtctgctattattatccagagggcttacagacgctacctcttgaagcaaaaagttaaaaaggtatcaagtatatacaagaaagacaaaggcaaagaatgtgatggaacacccatcaaagaagatactctcattgataaactgaatgagaattcaactccagagaaaaccgatatgacgccttccaccacgtctccaccctcgtatgatagtgtgaccaaaccagaaaaagaaaaatttgaaaaagacaaatcagaaaaggaagacaaagggaaagatatcagggaaagtaaaaagtaaaaagaaaccaagaattttccattttgtgatcaattgtttacagcccgtgatggtgatgtgtttgtgtcaacaggactcccacaggaggtctatgccaaactgactgtttttacaaatgtatacttaaggtcagtgcctataacaagacagagacctctggtcagcaaactggaactcagtaaactggagaaatagtatcgatgggaggtttctattttcacaaccagctgacactgctgaagagcagaggcgtaatggctactcagacgataggaaccaatttaaaggggggagggaagttaaatttttatgtaaattcaacatgtgacacttgataatagtaattgtcaccagtgtttatgttttaactgccacacctgccatatttttacaaaacgtgtgctgtgaatttatcacttttctttttaattcacaggttgtttactattatatgtgactatttttgtaaatgggtttgtgtttggggagagggattaaagggagggaattctacatttctctattgtattgtataactggatatattttaaatggaggcatgctgcaattctcattcacacataaaaaaatcacatcacaaaagggaagagtttacttcttgtttcaggatgtttttagatttttgaggtgcttaaatagctattcgtatttttaaggtgtctcatccagaaaaaatttaatgtgcctgtaaatgttccatagaatcacaagcattaaagagttgttttatttttacataacccattaaatgtacatgtatatatgtatatatgtatatgtgcgtgtatatacatatatatgtatacacacatgcacacacagagatatacacataccattacattgtcattcacagtcccagcagcatgactatcacatttttgataagtgtcctttggcataaaataaaaatatcctatcagtcctttctaagaagcctgaattgaccaaaaaacatccccaccaccactttataaagttgattctgctttatcctgcagtattgtttagccatcttctgctcttggtaaggttgacatagtatatgtcaatttaaaaaataaaagtctgctttgtaaatagtaattttacccagtggtgcatgtttgagcaaacaaaaatgatgatttaagcacactacttattgcatcaaatatgtaccacagtaagtatagtttgcaagctttcaacaggtaatatgatgtaattggttccattatagtttgaagctgtcactgctgcatgtttatcttgcctatgctgctgtatcttattccttccactgttcagaagtctaatatgggaagccatatatcagtggtaaagtgaagcaaattgttctaccaagacctcattcttcatgtcattaagcaataggttgcagcaaacaaggaagagcttcttgctttttattcttccaaccttaattgaacactcaatgatgaaaagcccgactgtacaaacatgttgcaagctgcttaaatctgtttaaaatatatggttagagttttctaagaaaatataaatactgtaaaaagttcattttattttatttttcagccttttgtacgtaaaatgagaaattaaaagtatcttcaggtggatgtcacagtcactattgttagtttctgttcctagcacttttaaattgaagcacttcacaaaataagaagcaaggactaggatgcagtgtaggtttctgcttttttattagtactgtaaacttgcacacatttcaatgtgaaacaaatctcaaactgagttcaatgtttatttgctttcaatagtaatgccttatcattgaaagaggcttaaagaaaaaaaaaatcagctgatactcttggcattgcttgaatccaatgtttccacctagtctttttattcagtaatcatcagtcttttccaatgtttgtttacacagatagatcttattgacccatatggcactagaactgtatcagatataatatgggatcccagctttttttcctctcccacaaaaccaggtagtgaagttatattaccagttacagcaaaatactttgtgtttcacaagcaacaataaatgtagattctttatactgaagctattgacttgtagtgtgttggtgaaatgcatgcaggaaaatgctgttaccataaagaacggtaaaccacattacaatcaagccaaaagaataaaggtttcgcttttgtttttgtatttaattgttgtctttgtttctatctttgaaatgccatttaaaggtagatttctatcatgtaaaaataatctatctgaaaaacaaatgtaaagaacacacattaattactataattcatctttcaattttttcatggaatggaagttaattaagaagagtgtattggataactactttaatattggccaaaaagctagatatggcatcaggtagactagtggaaagttacaaaaattaataaaaaattgactaacattttaaaaaaaaaaaaaaaaaa

SEQ ID NO: 4 - protein, 2005 aa, Homo sapiens
MAQSVLVPPGPDSFRFFTRESLAAIEQRIAEEKAKRPKQERKDEDDENGPKPNSDLEAGKSLPFIYGDIPPEMVSVPLEDLDPYYINKKTFIVLNKGKAISRFSATPALYILTPFNPIRKLAIKILVHSLFNMLIMCTILTNCVFMTMSNPPDWTKNVEYTFTGIYTFESLIKILARGFCLEDFTFLRDPWNWLDFTVITFAYVTEFVDLGNVSALRTFRVLRALKTISVIPGLKTIVGALIQSVKKLSDVMILTVFCLSVFALIGLQLFMGNLRNKCLQWPPDNSSFEINITSFFNNSLDGNGTTFNRTVSIFNWDEYIEDKSHFYFLEGQNDALLCGNSSDAGQCPEGYICVKAGRNPNYGYTSFDTFSWAFLSLFRLMTQDFWENLYQLTLRAAGKTYMIFFVLVIFLGSFYLINLILAVVAMAYEEQNQATLEEAEQKEAEFQQMLEQLKKQQEEAQAAAAAASAESRDFSGAGGIGVFSESSSVASKLSSKSEKELKNRRKKKKQKEQSGEEEKNDRVRKSESEDSIRRKGFRFSLEGSRLTYEKRFSSPHQSLLSIRGSLFSPRRNSRASLFSFRGRAKDIGSENDFADDEHSTFEDNDSRRDSLFVPHRHGERRHSNVSQASRASRVLPILPMNGKMHSAVDCNGVVSLVGGPSTLTSAGQLLPEGTTTETEIRKRRSSSYHVSMDLLEDPTSRQRAMSIASILTNTMEELEESRQKCPPCWYKFANMCLIWDCCKPWLKVKHLVNLVVMDPFVDLAITICIVLNTLFMAMEHYPMTEQFSSVLSVGNLVFTGIFTAEMFLKIIAMDPYYYFQEGWNIFDGFIVSLSLMELGLANVEGLSVLRSFRLLRVFKLAKSWPTLNMLIKIIGNSVGALGNLTLVLAIIVFIFAVVGMQLFGKSYKECVCKISNDCELPRWHMHDFFHSFLIVFRVLCGEWIETMWDCMEVAGQTMCLTVFMMVMVIGNLVVLNLFLALLLSSFSSDNLAATDDDNEMNNLQIAVGRMQKGIDFVKRKIREFIQKAFVRKQKALDEIKPLEDLNNKKDSCISNHTTIEIGKDLNYLKDGNGTTSGIGSSVEKYVVDESDYMSFINNPSLTVTVPIAVGESDFENLNTEEFSSESDMEESKEKLNATSSSEGSTVDIGAPAEGEQPEVEPEESLEPEACFTEDCVRKFKCCQISIEEGKGKLWWNLRKTCYKIVEHNWFETFIVFMILLSSGALAFEDIYIEQRKTIKTMLEYADKVFTYIFILEMLLKWVAYGFQVYFTNAWCWLDFLIVDVSLVSLTANALGYSELGAIKSLRTLRALRPLRALSRFEGMRVVVNALLGAIPSIMNVLLVCLIFWLIFSIMGVNLFAGKFYHCINYTTGEMFDVSVVNNYSECKALIESNQTARWKNVKVNFDNVGLGYLSLLQVATFKGWMDIMYAAVDSRNVELQPKYEDNLYMYLYFVIFIIFGSFFTLNLFIGVIIDNFNQQKKKFGGQDIFMTEEQKKYYNAMKKLGSKKPQKPIPRPANKFQGMVFDFVTKQVFDISIMILICLNMVTMMVETDDQSQEMTNILYWINLVFIVLFTGECVLKLISLRYYYFTIGWNIFDFVVVILSIVGMFLAELIEKYFVSPTLFRVIRLARIGRILRLIKGAKGIRTLLFALMMSLPALFNIGLLLFLVMFIYAIFGMSNFAYVKREVGIDDMFNFETFGNSMICLFQITTSAGWDGLLAPILNSGPPDCDPDKDHPGSSVKGDCGNPSVGIFFFVSYIIISFLVVVNMYIAVILENFSVATEESAEPLSEDDFEMFYEVWEKFDPDATQFIEFAKLSDFADALDPPLLIAKPNKVQLIAMDLPMVSGDRIHCLDILFAFTKRVLGESGEMDALRIQMEERFMASNPSKVSYEPITTTLKRKQEEVSAIIIQRAYRRYLLKQKVKKVSSIYKKDKGKECDGTPIKEDTLIDKLNENSTPEKTDMTPSTTSPPSYDSVTKPEKEKFEKDKSEKEDKGKDIRESKK

SEQ ID NO: 5 - DNA, 19 bp, Artificial Sequence
  Oligonucleotide primer
tctgggcagctacttgtgg

SEQ ID NO: 6 - DNA, 28 bp, Artificial Sequence
  Oligonucleotide primer
aatacgttgagcacagaggtcagaagga

SEQ ID NO: 7 - DNA, 23 bp, Artificial Sequence
  Oligonucleotide primer
gttgctctgctttcttgaacctc

SEQ ID NO: 8 - DNA, 24 bp, Artificial Sequence
  Oligonucleotide primer
atgtcagccaatccttctaaagtg

SEQ ID NO: 9 - DNA, 25 bp, Artificial Sequence
  Oligonucleotide primer
tcctatgagcccatcacaaccacac

SEQ ID NO: 10 - DNA, 25 bp, Artificial Sequence
  Oligonucleotide primer
tcctatgagcccatcacaaccacac

SEQ ID NO: 11 - DNA, 23 bp, Artificial Sequence
  Oligonucleotide primer
gaccgtgtaatggaccaatgatc

SEQ ID NO: 12 - DNA, 23 bp, Artificial Sequence
  Oligonucleotide primer
gaccgtgtaatggaccaatgatc

SEQ ID NO: 13 - DNA, 21 bp, Artificial Sequence
  Oligonucleotide primer
caccagttctctgcctgtctc

SEQ ID NO: 14 - DNA, 20 bp, Artificial Sequence
  Oligonucleotide primer
tcaggtggatgtcacagtca

SEQ ID NO: 15 - DNA, 30 bp, Artificial Sequence
  Oligonucleotide primer
tctgttcctagcacttttaaattgaagcac

SEQ ID NO: 16 - DNA, 23 bp, Artificial Sequence
  Oligonucleotide primer
tgcatcctagtccttgcttctta

SEQ ID NO: 17 - DNA, 100 bp, Artificial Sequence
  oligonucleotide sequence
tcttaggtaaggatccgaaggggaaataaaacctacaggatgagaagcgtcgacgatggcacagtcagtgctggtaccgccaggacctgacagcttccgc

SEQ ID NO: 18 - DNA, 150 bp, Artificial Sequence
  oligonucleotide sequence
cagcctatagatcacttagatttagatccctaaaatttgctgtcactctgtaaagtgcacctcgagataacttcgtataatgtatgctatacgaagttatatgcatgccagtagcagcacccacgtccaccttctgtctagtaatgtcca

SEQ ID NO: 19 - DNA, 200 bp, Artificial Sequence
  oligonucleotide sequence
catacacttcattctcagtattgttttgccaagttctaattccatcagacctcgacctgcagcccctagataacttcgtataatgtatgctatacgaagttatgctagtaactataacggtcctaaggtagcgagctagcagcttcggttttgatacactgtttacagcctgcgaaggtgactcactcgtgttaataaga

SEQ ID NO: 20 - DNA, 101673 bp, Homo sapiens
gcctcttaggtaaggatccgaaggggaaataaaacctacaggatgagaagcgtcgacgatggcacagtcagtgctggtaccgccaggacctgacagcttccgcttctttaccagggaatcccttgctgctattgaacaacgcattgcagaagagaaagctaagagacccaaacaggaacgcaaggatgaggatgatgaaaatggcccaaagccaaacagtgacttggaagcaggaaaatctcttccatttatttatggagacattcctccagagatggtgtcagtgcccctggaggatctggacccctactatatcaataagaaagtgagttcttagtcaagttgccttcactgcctatttactaattggttctgggctagtcccagggatgatggtgaagaaggctggcctccttccctctgtctaaagtatcactaagatgctggatgggcctgaccgtgtaatggaccaatgatcctagaagtcttttggaagcactcatttgaacctgcatttgtgagacaggcagagaactggtgaggcatcctccagcgcgggaattaaggaaggacaaaagcctattcaccttcttgaatacaaattatatgcttaaaccagtgtaaattgaccctgattccctaataatgttgagaagcaaaaactgtaaactaggagtctatttaaattttattttttatatttgcaggagtagtatctaaattcctctttatagtctctagctctccataagtcactttgatcttcagtgggtttaattattcctttataccatactttctcctttctattgctctccacagaaggaataatagcaggtgacttgtaggtgccaaataagattctgagcaaagaacacacctggaaaaccttgaagttctcatgagaaaattttctaaccaaaaaaaaaaatcaaagcctcaattttgtgctttatgtgaattataaatgcggttttaaaatacttacattaaaacttgataaagttgctaagaattcctatggcattgatcacaaattttcttaataatcctcatgtcatttatcaaatttaggaaagtttatagtgctcagaaaaaaaaagcatctatcttcatgtcatatgatggtaattattatgttatacactattttacagggcaatatttataaataatggttttacttttctcttaaaatattcttaatatatattctaagttttattttatgtgttgtgttttctttttcagacgtttatagtattgaataaagggaaagcaatctctcgattcagtgccacccctgccctttacattttaactcccttcaaccctattagaaaattagctattaagattttggtacattcatatcctttttcaaatcgtcacttaatatgattttcttctttgaccaagttattgagctacacattttccaaaatatctgtggttggcaatgttatgtgttctttctttttctttccttttactcaatcgttagcatgttgcaaaatgagatcacaggtaagtgaattactttcccccgtcttctaagtgtttcttctctacccaactcactattacttctttcttctcttttcttctcccttacgaattgcttgccacatcccaagcctttctcattaattttgaccatgttaccaggctttcctcctgtaagtcttcaatttacaatgttaggtaagggagtaaactccatgagctaattttctttactgcttttacatttggaaaataaatatacataatctgaattacaattttgtatgtttttggtctgaattttatgactttcttctattttagcatttaaaagctttgagttagtaagcgtttacaattgtgtctgtaggtataacaccctttcaaatacttttccaaatttgtttcgcaacagccttcttattgatcttttgctttctattcttttcctttctttttctttttatcacttgttcctatgttttattgaagtcacaagtcttgctacaattatccctctccaaaggattaatgtctatctatccatatacattctcattttattttttatactccttattgaagcacctgctttccaaaaatgagattgatgacatcttggtgggagatggcaatttgattgattccttgaaattaaatagagtagttggaaatgagagattttattctaggccagaaacaagtcttgttgacagccagtcttgggaatgccaatgaagcaaaggcttggaagactgaagctgtgtggggcaggggcatttacacgaagaacacagaagtcatgggaggaggagtgatatgcttcaggaatcagaggtaaggcaggggaactgaaattaagcaaatcctcagattaggacagcatgttatttcttcttcagaaagaatcgttgcttggaattccatgatgtggttagcccagggcctggtattaaggctttcagtataaatattctccacctttagcaggcctagaaaatatttgaattagataaggtatggaactaaattaagtagggaattcaggaaatgggataagcctggtacagggtacttatgtcatttctgggtggaggggatgtaaagcatgtccctagacttgcctcccagtatggcaaatgttgtctttagaagtgtaacattctgtaaagtctccttttaacctctaggttgttcctcttccccagtttaggtggatatcaacatcttttatttgatgtttatgtttcatgttttaagatttcctagtttcttggcattaccttaagcaataatgttttcttacctctctctgttttccaaataagagaacccagtagcatgtggggaaaaagatgtctttgagttagcattagaaataaataataaagttggaatttatatttgggtctcatgattataaattatgatctattattatgtttcaagcatttgtaatctgtgcagtgaataaatctctgcataaactattcattatattttaaaataattgtatgttccttatgcaaacgtaatttatatataaaattacgtggaaaattctagcctagaactagacttctgttcctagtagacattgggaaaatattcattaaataaataagtgactagtaagtcagagattagagaatcagatacaaaaaaagtgaaaaaataagtttgaatggatcagaaaaaatctttcttgtcgtgcatctgaatgatgagatggagttaagaaaacccaatatatttgttttttacaaaagcagatttttgttttaaaacttttgtaatagaccatggaaaatctcatgaaaactattgtccccacttgaaaaaaaaaatcctaggagattatgaatccccatttaaaactccctggaaaagagactcctggtggtagagggtaagggcagtttaagaaattctgatcagagaatatgagtactaaggacacagtttgtgccaggacctctctagatatccagatacaacttgaatctgtgggcttgtatttgcttcctgggggaaagaactcaccctccacaggctgaagtcattgggaggcctgaggagatgcaggttgaaatgtgaagccagccaggcaaatctattaaggtatgccaagttgagctgttgattctctgagaagtttacagatggcttagagtcacaaatttattccaatgtagaaaattagattttaaaaagtctctaatttcctgacttaaagtgttatatttcagatgtctcaccttggagcagagatataacaaaaggcagtgaggctaatagtctaagatacatgaatccttccatgttttggtgatgctggtgcaattgatcaaatagcccagtaaagttagaggtatatagatgctgtagttagtaactgattttcacaataattttgtcctttattcctcttgttgcaaaccctagacttaaatcctgattttctgacttcaagtacagtgtcttttactgtaagttaaaaatgcttggagagatggtcatggttgtttggccacagttgggaggtcattgtatatttattaccactagtttataaaccaacaaggagccattcatgttaaataagtttttattttaaacttggactaatacctctatttcaaacaaaaaccttgacttgtttctcaaagagctgttatctattaggagctattgtgtatcaaattagcttttttaaaaatttattttggctgaatgagaaattatgcttgtgatatttttaccagggtgcattctgaaaactgaaaattcttttgatgtgcctagtgtcttatttgatatttaaataaaacatgatttattttctagataacaaacaagttaaaaataatctatgttcctaaagttccctaccaagcttttaaatgtgtttcctgtcagcttttattattttaagttaatatatgcacactcctctaatttattttgcatttgttactcatttgttcatttgcaagtacttactgagtatctaccatgtggtagatattcttgtaagcattgggatgcaacattgaacaaagtgaagttcctactctcatgtagttacattcatgtgagtgtgtgtgtgtgtttggaagaagaaagacaataaacaaatacgtcgattgggagctagtgataagtgttactaagaaatataaattagtgtcaaagggaggagtgacaaggtgttgttttagattgtatggccagtaaaatcctttctgaaaaggtaccagttgagcagagatccgaaggaagcaaaagagtgagatatgggaatctagggataaagtcagttcaaggagaacagcaagtatgaaggtaaagtctgaaggtggtggtgcaactagtatgtttaacaatcagcaaggagacctgagtggctggagcagagtgggaaaggcaggaagcgagaggatgacatcagtgggagtgaaggtcaggggctaaagttgtaggcgaggtgcagtgggtcattgtgaggacaccacatttactctgaatgagactccaggagggttttcagtagcaggatatcatgacttgactcacatatttaaaagatcactctggctgcttcatggagaatagactgcataaggggaaagagtggaagcaaggagactgggaccgattgtcattatgaaggcaagagagcatggtggcttggagtatggtggaaacaatgaggatggtaaaatgtcatcaaattttgaggtattttgcagaagagctgacaggatttgctgagcaattggttgtggtgtataggaggaaggcagggactaaggatgattccaagcatttagtctggtcaagaaagaaaaatggagttgtgttgactgagcttggggcaacttgagcaaaccaatttggtgggtaagatcaagatcttggttttgaacatgttatgtttgagacacctattagacatcattggaggagttgaggagttaggtggctgtgcaaatctggagttcagaaaagggctgggctggaggtgttcaactttgggagctgtcagtgtacagctggtatttaaagtcatgacattggactaggctgccaaagagctgagaccctccctccaaatcacactagtaatgctgaactacctatcatttgaaaatggtaggaaaatggaaaacataggttttggtatcagaaaacgtagattcaaaccctatctctaaaatttactttttagctatatgatcttagtccaagttactccaattctttcgaatctcagtttctctatctgtaaaattataatcacagcttagacattaataatgataaaatgtatgacaagtatctagcaccagatcccatgctagtacttagtaggtactcaataaaggatatctatgacagtaatagctaaaattctagcagcaactgctgtaagattagcaaaaaggaaactctcatattccttaaggaattgcacaaagaactttatagaaatccctactctgactctgcaaacaaaatctttatatagcaccagagtttagacctgcaactgacccaaacaatgtggtcagttctgtctcattttgtagatgagttcactgaaacccagagatatttagttttttctaaggctacattttctatcagtggcagagctaaaacttcagaccaggttttttgattcttggctctttgcattttgcatccaatagaaaacaaatgatttttaaaccctcggatttaatatacttggggcattgccagtgttcttgttttatgcatttcaaaggtgcttcttagttgctccaacttactgattcattaaatagtgtccatactgagatataaaatatcatggttttccatgaaaagaaatatacaggtttatatgaaagcagatgacacaacaatttctctttcttttgttttcaatgctcatatgttatcatttagttatctactggcaaataggagtttgttcatattaaaattaaacaatccaatatttaacactgtatatgtgacatttactcgatttttctgctggctcagaaatatgcactggtatgcagaaaaagacctattctattctacttcaaattatccatttttacattagaaaacctctaacatcaggctatcttctacttctagtttatatataggttaaaaactcctctgcaacttctctggatattatacattattacaaagtctctgaacagagcataatgtcttttccttcctatagaataacaaagaaatgtcctataattttatactctataaatgagttattaatggtaagaaaccaataattattatcttagtggataatgactgtatactgtaagaaaagtattatccacatttatataagaaaactgagcctcaaagaattaaacaaattgctgaagcccacatggctggtaagggatgtatctgaccatggttcattgctctaaatctcatggtgcttcatcctcgctccacggagacaggggtgggtgtgccagtgttatgatgatccaggctccatgtcaagggctacttaaacaattttcactaaaaacttgaagaagtgtttcttcataatatacacaaaggaaatattttacatttgccaactcgcaggttagtatcaatcaacaggtttacccactgttatgtatacctggcataaagaaattaatagattaaaaaacatctttgtcccctgatattataaaaggtttatctgcctctattttattttacattgaaaagttcttaaagcaatattgttccaggatacagtgttcttttgaaaaatgtactctatgacttggattacacatttaaaaaataatataggatgtatgcattttgctactagtttgagccttttgaaatctgctttgacgtggggtttctatacttttttgatgcatggcatcaccaatgcaaaatccatacctacattaaatacttttgtatttgagtttttgttatttgagtttttttttttttttttttttttgagacgggttctcgctctgtcgccctggctggagtgcagcagcgcaatctcggctcactgcaagctccgccttccgggttcacgccattctcctgcctcagcctccggagtagctgggactacaggcgcccgccaccacgcccggctgattttttgtaattttagtagagacggtatttcaccgtgttagccagggtggtctcgatctcctgacctcgtgatccgcccgcctcggcctcccaaagtgctgggattacaggcgtgagccaccgcgcctggccatatttgagtatttttaagatcatctgaaactatttcagtcactcaccagaatccaggaatttgtaaagtatgtgactgatgaaataaattaacaatgatttagaaacttagtgaattttaagcctttctatttagagatacctatcaaaccacaagcgtaaaaacttgaccctagttatctactatttttctattaaaagcaaaattgttctttttatgtatcagaagttttaacttaagtgtatacttttattaaaatgatagccatgaaataaggaaaatgcctgttttcgacttattatcagtgactaattagaaaataattatttctcttgttaatgttgaaatatatattttacttttttatatataactaaattataccactataaagagtaagtttttaagtgtcataaaaccattgccgagtccataatgcagcataattgcataaggctgttaatttccaccttatatttttcttatatttttaccctcaaaaaatgtagaaacttgtgtaaacaatatgtatatatattttagacagagtctcactctgtcacccaggctggagtgcaatggcgtgatcttggctcactgctacctctgcctcctgggttcaagtgattcccctgccttagcctcctgattagctgggattacaggcatccgtcacgcctggctaatttttgtatttttagtagagacagagtttcaccattttacccgggctggtctcaaactcctaacctcaagtgatctgcctgcctcagcctcctgaaatgctgagattataggcgagagccatggcacctggccaacaatatatttgaagacaaactttatgctgtatttttaaataatttatcagaaattgtttttaaaaactccatttagtaacaaatgaattgcaaaattaatttcattagtcaactgacactgtgaaatagcaaggctataatggtgaataatatagacatgattcctgtcctcatgacgctcagagagtagttgagaagatcatcattaaaatttgtcattagaggaataatataagggctgctggggtatataactggtaataggtcaatctgagtactaaagaaaaagagaggtgacatttccaagaccctaaagtcagaaacagcatataaaacattcataacatttgacaacctaaaataattacagtattatccaaatggggataatgcaatgaagagaaaagaaaatgaaactggagaagtagacagggatcagacctcctagcgtcttgactctgtgttaagacatttgatcatcatcctaagagtaatagaaagctaccaaaatgatgcatattacatttacaatggtcgtgttagcacagtatgcagaatggattaaatggagccaaacatgaatttggaaacatcagtttagaggagactgcaataatctagatggactattagatttgatgctagtcttgacagacacttggaccatgcagtgatatggggatggaaaaaagtaactgaatccagagatagcaggcagaattgacaatatttgatggttaattagatatgaacgtttaaggggagacagaaatctaagatttctcataggtctctggctatattatgcacattttataagacacagagacgtcaaaggagtaagtaattagcaggaatggaggggtagattaaaagatacttttcaaaagttcagttttagaattcaaaatttgaagtgttgataagatatgtaagtacagatgtcctatggacaatcaagtatgtggaattcagaagagcggtctcacttggagagaagtatctgagaatggtgggtatataatggttatgtttgttgagcaatgtttgttgatggactacactaggatgaggagagtagaagagaggtagatggcttacataccttatgtctttcttttcaaaaagaaaaatgccacatttcaaagaatacagagaaattggtgccctgaggcatgaagaagccagggaattggaacctcctgaaagcagagggaagataacttaatgctaaggggaggaaccatccttgttgaatgctgcttagaaagcatgtcaaatataatctcaaattatccttttgtttttagtgacaaaacgtgaagatgttgccatctttagaaagaaaagctggtaggctgaatatatgatagatatataagaaaaggaaagataagcagctctttcaaaaagtttggccatgatatggaaaagggagataaggctgtagtagttaaggagggttgtgagtcataggagagaaatatcctttcccctatgccaggacaagggagacgtaagcaagtttgtgttgctgggaaaaagccagtaaggtgggagccattaaggataagaaaagagagagataagagattgctgaagtcttctggaatggggaaggtgtccagaataccggtggagggattggaaacctccccactgtaacaggaaggaggaaagaattggtctcaatgtggaaaagtttgttgatttgggggtgggaagtggaggcggggcattgtgatgctgtctcttctctgtaaagtagaaaataagttttcagcttgaaatggagccggaagaaagaagagggttggaagctggaggaaagtggagaatatttgaaatttttctttgcagagagtgggagatggagcctagtaggaaaatacaggactgtgttgaggaccactgaggtttgtgaccataaatttagaatggtgccaatctgccacggggtgttatttttccccaatagggctcagcagaccaacaagcacaggggaccctctagttttatataccaatagcaagtcattctttatttaatttagttttttgtttgttatagcaataaagaaaaattgtgtttctttgaaatggtattttgtgtgtgtgtgtgtgtgtgtgtgtgtgtgtgtgtgtgtgtgtgtgtgttctctagattatagtgccctcacgtggctgatgcacatcatttacttatgagtgttttcatatggatgaaaaaactgagaattaagcatgggccttacagcacagctactaaaattaaaaaataataattattattattgttttgactaaaaccagtactagatgcaaatgaactttctttctagatcaacacaacattgtccagttgtaatagtgttgatatttcattatgtgtaagtaatgtgatcatttatagtaaaaacattaggagtgagaaaagatatgaagagcacgtatttcctctctggaatttctataattgtgtccagattcacaatgataaagagtgccactttacataatggcaactaaatctttattatgctttttattaaatatgaaagtcattactattatctgatactgaatattttcttaaatagttgttttggtttttgtcttttgctgttttttaatgtcaaggaaagtgaagggcattggctatacctgcaaagacaaagtgggatagggtgaaaccaacccaatatttgtaataaactgtgttctgtatgatccaggaagcaattcattgagcatctattacgcactagggccattaagttgaaggagacttacatattttaacaaatttgatcttcatagcaatcctgttacatgattactttttcttacttttataaccaagtcaattgagattcagggaacttaataagtaattttgccttagttacaaaccccagaaatgccagtgctaacacctgccatcttctctcatagttcaggattttatgagcaattacagtatattataccctctgtttagaaaggaccttattataagacattccaccagggtaacttttagaatgatgttataatacatttaattaattacttgaattgtcttgttgaatttttgccagggtttacatatgtgctgaacttgcagttttaatgttcagttgagtctgtcgttaagaaaatttaagttgataaattattcactgatgaactactttctttgcatttaatctttttaattgctaaaggtacctaaatagcctcaaaatagttgatggcttggcctgaagacaagatctaaatatgaggttgctgagttatagaaatggcaaaaaaaagggtcaataatagaataataagcaacaaaataatagtaagcactaaagttttaaacttcatggtggtgaaggcatggtagtgcataaaagtaagatttttccattgaactttgtcttccttgacgatattctactttattcaatatgctcattatgtgcacgattcttaccaactgtgtatttatgaccatgagtaaccctccagactggacaaagaatgtggagtaagtataaatatttttcaatattgacctccctttatgtttcatattgtgcttttaacaccttgagacctcctcaatttctttaacaaatcatgctagctactgttaaccagaccctgattcaaattcatttctgtcactaaatgtcttctaggacaaagcttgtagtgggctcacttagttgtgtaaattactgcagtagtttgactgctattatctgcagccctttatcttctttgtgagtcttatgttcttttgaagatcaccagtgatttactaatatctactgataaaaagtatacctagtttttatgttccttttttaatgactaccacagttctgtgttactagtatatgtttgatggcttttaatggtgcatattttatgaaatacaaatgcttcactcatttttgtattaatacctatttgctcaaatcggactgaatgccagtgtatttcagattatgtcttcatatagagccacattatttggatcctttaaattaattaatgtggaaaatgcaatatacatttatttacagtcaatgagaatgtcttttggaatttaatgtttcttttttgacttaagccccacctaaactctatatcgtagggggaccaacctggaagtgtctaatttttgtttgctgtttatgtcatctttaagatatgtacttgtaaattaaccactagatttttaatgtgagcttggctattttctctcaggtatacctttacaggaatttatacttttgaatcacttattaaaatacttgcaaggggcttttgtttagaagatttcacatttttacgggatccatggaattggttggatttcacagtcattacttttgcgtaagtatcttaatacattttctatcctggaagagtaaatcactggtgggagcctatactatattttccttggtggcttgccttgacagaccaagcatttttcttagtaatcatagttttcttccaatcaaattatccagtttggagaaattaggaactatcatagtaaattacatggctttggtttcaattagcactgtaaagtaataaagtttcccaaataacagagattatgattgatgacaatgccattttcctcttaattgggaaagctgatggcgacactcatgaaattaaaaaggtcttgatgaaagaccaaggaagacgtagatttccctaaattctgaataactctgatttaattctacaggtatgtaacagaatttgtaaacctaggcaatgtttcagctcttcgaactttcagagtcttgagagctttgaaaactatttctgtaattccaggtaagaagaaaatggtataaggtggtaggccccttatatctccaactgtttcttgtgttctgtcattgtgtttgtgtgtgaaccccctattacagatatgtgacagagtttgtggacctgggcaatgtctcagcgttgagaacattcagagttctccgagcattgaaaacaatttcagtcattccaggtgagagctaggttaaacaccgaggctgactttagctacagtggtgctacaatcacagcttttgtgcagaagccttgttgctagttgcatattgcaaataaatatgtaaaaaagcaagaattggtacatcattttttggatggatttgattctttgctttttactcgttgctttctttaaaactattctaaatcagcctttgagtttaacaagtgttgcatgaggcatttgcagtaacaggctacatggtttgcatcctataacatcaagctttccgcatagaagctagactaagagacattcagactgatgcaaatttgacagtttaggcctaaaactggcaatcttttaagctgcagataaatgaaagagcaagggatagcatgagtgctgcatggggctcagatttcagatgtcttcctttttttaacccatactcaagcttgcagaattcacaaatatataacctcataattcatcgacttcaagatttcttactactctattcacatagacttttctaaaaccaataaggggttagggagtaagacatctgcaaataaaagcaaaatatttacacaaggttgatgtttaagcatgaataacaaaatcattcttttgctctaaagagtgtttggaaatacacatttggttcatttccattcacagttttctaatgaacatacaagttctgctttcattcattttcaccagctagcaggcttttcatgaaaatgttattcaatcacaaacattaaactaatattgttggcattctgcatgacatttttattttccaggacaagctcatgatatttttgccggtaaaatagctgttgagtagtatatttaaattcccccttctgattttgtttgtaggcctgaagaccattgtgggggccctgatccagtcagtgaagaagctttctgatgtcatgatcttgactgtgttctgtctaagcgtgtttgcgctaataggattgcagttgttcatgggcaacctacgaaataaatgtttgcaatggcctccagataattcttcctttgaaataaatatcacttccttctttaacaattcattggatgggaatggtactactttcaataggacagtgagcatatttaactgggatgaatatattgaggataaaagtaagatatactctataaaccattaagttgtttagttctctaaatattaaatattatatataatggaaattatctcaatttagatgtgaatcaagtgacttagactaatttaagatgatttaatacatataaaagagatatcaaatgataccttattctatttttcttatctgtccattgatatagtaaaagttctcatttgaaaatgtgttgtcttatactcatgttgaaagtaatttcatattatgccatattaaaaaatgtttatttggtagacattaatcaggtttttcagtcattttaataaataagtcagtagtttgaactattcagtgtattccactgaaatgtgttaagaagactgaggggaaataatttggccctatttggttgatgcaacatatgtattgagtacatatgctatatctgaaaatagagaaaccatttatcaagatgaaataagaatttgtgtgctcctcagaaggttaagtaaccctgatttagccattcacttattcatattctaattagtccctttagtgtcatcattgtattgtagttaccagtttagtttgattatatttaaggtatgaacatcagaataagcttatgccatatacttcagcatgatttcttaacattgagcccagcccctctgtcatttttcatatgtgtgtgcatgtttgtatgtgaatataaaaatacgtatgtttgcatgtgtgtgcatgttttctgagatcatctttgcaacttactgaagttatatgtcatgccttaaaaataaaaactagatagctctccatagcttaaaaataaaaactagatatactcagacaacatatctctccaaagaaacaagtttattttcttcatttgaaaggcagaaatcaagcaaaaatttcaaacaaaacacttatttacagtatcataagagggaataaatacctaatcccacttctcacaggaaattaagttaaaattggcgggaaaaaatgtctgaatctattttgagcctggggagaaaagtatatgtaaggtaaaatttatttgcatgaaaacacctagaaacaacaaggctttcttctttcttactttttgtgcccagcaatagactggcagctctttcttaatgtatcccatgcaatttgagcttatatttgcaatgaatgctgatataagaatgttatcatagtaattccttctgaacatttttctttttaacatagatttgctaaccatttgtataatcaaaaatgttatatattgatatttgttcaatattgtgaaaaatctctttagccatatatatttattagtttatccatctcattatgattgaaaacatttgtgagctttgccacctaaacagggtggctgaagtgttttacaggattttaatgattctttctattcctttctctttaaataggtcacttttattttttagaggggcaaaatgatgctctgctttgtggcaacagctcagatgcagggtaagtgatgcttcctactgagtttcagtccacactgctccatcagtgtcaataacctgccacctcccactcatccagtcccactcactcctcactcaaaaccctccataaattctacttcacggtgactctcagaatagccaggataagtgtagattctcacctctttcacacagtcatttactgcaattatttttctatgctaggtcacatctaatcttccaaattagttcaatgtaaaatagagaataaagcagtataatatgcatctgaagcttaatagaattcttaagcacatactttttataagtgtcatattttatatatactaatgtgttctccatagcttaaaatgtaagatctctgaaaataatgttaatatctgagacatggggagtatttagcatattttagcaaagtggttacaaacataaactggagagtctgcatagagtcagactttgactccatcatataatctcatttcttcttgccttcgtttccttatatgacaaatgggtataataatagggtttttgtgatgatgaagtggattaataaatgtatagctatttagatcgctcaataagtgcttgtaattgttattattgggatcatgcaaatgtttgctattaagaaacatggagctaaatcctaggaaaatttaaaaacacagttaattttctttatttagcaagattttagagccacacacaaaagtctaatgcactttctttggacgatgatactgtggacattagtagctaatacctgtagcaaaattcccagtgataataggctttccatttggctcctacgatcagtgctatgctgcctttatcttcagattccaatgataagtaaatcaattgattttcattccttgtttgtactgtactaaatgcgttacatacagtatcttcttcaatgtttgcaaatttgtgagacaggttctcttattagcccattctcacatgcgaggtgcctgaagattagcaagttaagtaacttgcccaagatcgttcagctcagaagtgtcaggcaagacattgaagccaggtctgcttgatcttcaaggtcctcctatgacatttttaccacacagtgtcattcactccttgcagcatgccccacctatccttttctcacttctttaccctgttcccacacttacacacatttctgcctcaagacatcctcagtgaaaatcaactttttccttacagacttttttaactgcccttaagtcccagaagatattaatcatgatatgattgcttttatatggagacataataaatataataatgacaattatgaatcacagaggaatccacaaagtagaccttatagattctgttattatataaatcagtccacttagtgctgagttaagtactgggtaaggtgagagaaatcggcttttttctagtgcctgtataaaacagacattggcatatattaaaacaggaaaaccaattagcagacttgccgttattgacttcctttctttcctctaacctaattatagccagtgtcctgaaggatacatctgtgtgaaggctggtagaaaccccaactatggctacacgagctttgacacctttagttgggcctttttgtccttatttcgtctcatgactcaagacttctgggaaaacctttatcaactggtgagaacagataaaatcatttttctgagaatcataaaacaccgaactcaagagaattgctgtagaatattttattacttagagtgtaagtttgtaacatcctatataaaatttattaaaatctctcttccattttgcagacactacgtgctgctgggaaaacgtacatgatattttttgtgctggtcattttcttgggctcattctatctaataaatttgatcttggctgtggtggccatggcctatgaggaacagaatcaggccacattggaagaggctgaacagaaggaagctgaatttcagcagatgctcgaacagttgaaaaagcaacaagaagaagctcaggtatagtgaacaagcatacggtcctttgtttttctttatctaaattctttaacctaaatgttgaggtcagtggcaaggtagttgacattagaaataggtcatatgtgtttggtaagtgctaggagcctgtttggttattaagaagttattactttattgcaatgatctctgtcaatagtgtcaatagtaatggcatcaaaaaatggataattataattgctttactgacatttttttctcccttgtgactccttgaggaaattaatgattaacaaaggcctcatgtactcaaacttgcagagtagataaacctacatgtcctcagttgaagtattttcttaggggaagaggaattcagttacacttgcttcttcattgcagtatcaccagaggtggtaagggtcagaaaaccagaatcaaactaagaaaattatttcattgagtctggaaaggcaaaggcttattcaatatttgttctcttttatataaagtgtacaaatgcaagtttgtgggttacatcagtaaatcactagtgtgtaaacatattaaaacattagcactctctgcctcctactctacaaatcctttaatttggacttgacaagccttcaaaataaggcaagaatttctctaattatatttgcttgacttaatggcattaactaatccaattgcctatttttgtcttttcatgtatggtgaatacaattcccttttattaccgagtattcctaaatatgtaataaaggtcaaagtatattgctgtaatagcaacaaaactactgttatactttacaagttcatgcagatgccatgatctaggattctcaaataaacactctgtattatgtctttgctgtgcatttcttagtgaaatacccaatttaaatcacggagaaaaatgtcattaaaataaaatacttgactgaattacatttaataattcagactagcactaaatttctttattgtgtgaaaatggaatcaaaggcaaatgtctaccaggtttaaataggaagtctttaattcccatattatttccttcttaaaatattgtttgaattatagaacatgttattatgatctttaagtgtcttgctcatattattagataattagatatcatagtgtgaggacagagcttgaaggttctcataaaagtcgtatgtatcatcttccatatgaatgcccattttactctttgattggtctaataacaatgtactgttttctaaaacacagaataaaatggagaattgtttttcaagattatcttcatgatattgaagctcaattaagcagtaacatgataattactttttaagtttatatgcaacttccacatactttgcgcccttctaggcggcagctgcagccgcatctgctgaatcaagagacttcagtggtgctggtgggataggagttttttcagagagttcttcagtagcatctaagttgagctccaaaagtgaaaaagagctgaaaaacagaagaaagaaaaagaaacagaaagaacagtctggagaagaagagaaaaatgacagagtccgaaaatcggaatctgaagacagcataagaagaaaaggtttccgtttttccttggaaggaagtaggctgacatatgaaaagagattttcttctccacaccaggtaaaaatattaaattacatgaattgtgttctcataaattttttaaaaaaatatgccagaatttaatggagagaaaaccgccttccacctggatggcacaatgctttcagagtagtgatgattatcaagtgttttggctatcacttcagagaatttgtgagttttgcaactttttggaatcccaggaaggaaattttagatccctctgggtttggaaaaatttgcggttttgaggttttcttaaagactgaaaaatcttggagaaattttccacatcaggaattatcagcagatggttcccatctcttcttaactattgtgcgtggatctagtgaactttgggttttctgagtgacaaattcccagaagtggaccagagactcttttaggccacctgcggggttgttcccataaggtgcaaacatcacttgccaagtgcattcttcatgcctttgtttcaaaggggactgaaacaaaatatctctaaaagtagccaaaactctcagataggcaggtactgagggagatttatgacacgaaataaaaagtggtgtttagttgtacttgattatctgtgtttcatgttaaacatgggacttgcatttgaagaatactgtgatttataaactgcaacaaatattcactggatgcctctgccttttgtactcatgcaagttgttgaaattttaaaatttagaatcttaattgtctttgaaattaccaagagaattcacaggaatacacagtacctcagaagacattttcaccaggagtgaaaccttaatacctatacagtaacaataacaattacaacaacaacattgataatggctaatatttatacactgtgttgttatttgcaatattaatgcattaagcctttcactgcaaccctaggtaagttctaatttagttaatatccccaatttttatatgtgaagagaagcagggggctgcattctttgttgagtacctattttatgcttggcattctttctacattctcataattaatgctaacagttctgtagaatagtattattttcattactataatgaaaaagctattttggatcagtaaagttaaatagttgcacaatgtcatatagcaatagaaaaagttattatgatctttgagtgtcttgttcatattagggttgttggtattcaaattttgcctggtactgaaaaccttaaagtttccactttatcaagttgcctatgaagaatgcctttaaaaactgataaggaaatttacaatataactttatttaaaatacacaatggcattatactttctcttttacctttttataatatagacaagctcacataacctcacatgtgatatatataaatttttttaggtcagccttattcatttcaaatccaaataacatcataagattgcatacttggggattaattcaaatttaacataggatctttaaatatcaaaatttacttggtctctttcattttgttgtcacaatcatgattccattagtagaaacattaatcaataaataggaatcctttaaaaggcaaaccccctgtttacagtattagtcattctgaaaaggaaggaagaaaaagaaagggagggagggaggggggagagagagagagaggaaaaaagggagcaaaggagggaggaagatagagtatttttgcctacatttttacctaagtttgtctgaatttttgcctgaagttgtctaagttttggccaaaatttgcctaaattttggcctagatttgaaacttcatatcaacttcatatcaaacacttaccacagagattctcttcaatttgccttatttctaattgaataaaactaattctaggcaaaatagtgaagcctgataaggctaggctctgtccttcctttttctgtacattttgttcatagatatgatattctcccagcagcctcttcttcatacctctacatacctccatttcccagctagttgggtattataagcaatcactgacttagaagacatggcatggctggctcatattgatacttgtttcttaagcagtctctatataaaaatagagttaaagactttattttgcttgataaagaaatagtcaaacaaatgtctaagaggatggagagggagacagaaaaagacagagggaaagggaaagaaagagaaagagagaggggggaaaggagaaaaggaagaagagaggagagacagaaaaccctgaaatcacaccaaccccacttggcaagccctgaaagtaatactgaaaatgtcaaaccagatagaagtacttaatcttggtatagcaatggagggcccatcgtgtctgttagatttttaagagtttgagaccccaaaatattaggaattattgttttgtgatgacatgattgtgttggtaaccatctctgtgtttgtattgaaaaactatacaatgcaagcctttactgcaagattataatttctttagtagagtaagtggaaatatgaattgtttctcagactctgatttgacttgttagtgtggtaaagaggggagaagaaagtcaagaatgtaatctctaaacaagtttcaagataatctggatttttttgaaacctttataaggtacaattgaccttaaatcattactttattatttatttgtgataagctaggagtttaggagttttgctttttaaagattggtttggtatggggaatatttcttactggccatcttttttgtgtgttacagcatttgattactatgcatttatgtaatgaatgtcagcaaaagaagttgatgctaacggatggggcacaatcatttctcatatagctgtcacatgtaaactacgtttttgtatagcttaattcatccatgatccttgagaaacatgcaaacttataacttattttcttccaacccttctatggctccagctgaatggggtactggcagttaaaatataaactcttactaaaagcgatagaaacattcttcattgcaaagcatgtattgtttgcctttcttttttagctaatgaggagcagtatgtcacacatcctgcaaatcccgtaactgttatttcctcatagctaattcgaagtcccttgttagaggagagaaaggagacacgaaaaaggatggatagtctaagaaaggctttaaaaaataactacttgtatggaaaatgataaaagaaaagaatgaatgttactaatgtagttaataggattaaaaagcatgggaacaacaagaggagagatgacttctgttgtgggagcagtaagtcttcttagaagtagttctaggccgggtgtggtggctcatgcctgtaatcccagcattttgggaggccgagacgggcagatcatgagatcaggagatgagaccatcctggctaacacggtgaaaccccatctctactaaaaaatacaaaaaattagccaggcgtggtggcaggtgcctgtagtcccagctgctcgggaggctgaggcaggagaatggtgtgaacctgggaggtggagcttgcagtgagccgagatcacgccactgcactccagcctgggtgacagagtgagactccgtctcaaaaaataaataaataaaaaaaaagaagtggttcttactgtaaataatgaatagaatcacataagatagtgtttaacatttacagacatttaatagaaactaacagatattattgagaaaaagtaattctttagctggaaagaaaataaaaagcatacttattggtcagtgtattactctgttttcatgctgctgataaagttatacccaagactgggcaatttggcaaaggaagaggtttaattggacttacagttccatgtggctggcaaagcctcacaatcatggcagaaagcaaagaggagcaagccacaccttacatggatggtggcaagcaaagagagagtgaaagccaagcaaaagaagtttctccccatataaccaccagatctcatgagacccattcagtaccatgagaacagtatggggaaaacccctaccatgatttaactatctctgaccaggtccctcccacaacagtgggaattatgggaaatataactcaagatgagatctgggtggggacacagagaaatcatgtcattccacccccggcccctcccaaatctcatgtcctcacatttcaaaatgaatcatgccttcccaacagtcccccaaagtcttaactcatttcagcattaattcaaaagtccacagtccaaacaaagcctcatcggagacaaggcaagtcctttccatctatgagcctgaaaaatcaaaagcaagttagttacttcctagatacaatagggatacagacattagctaaatacagccattccaaatgggagaaattggccaaaacaaaggggctacatgccccatgcaagttcaaaatccagcagggcagtcaaatcttaaagctcaaaaatgatctcctttgactccatgtctcacatccaggttacgctgatgcaagaggtgggttcccttggtcttcagcagctccacccctgtcactttgcagggtacagcttccctcctgactacttccatgggctggcattgaatgtctgtggcttttccaggtacacggttcaagatgttggtggatctattattcttgggtctggaggacagtggctctcttctcacagctccagcaggcagtgccccagtagggaccctgtgttggggctctgaccccacatttcccttcctcactgccttggcagaggttctccatgagagccctgcccctgcagcaaacttctgcctgtacatccaggtgtttctatacatcctctgaaatctaggcagatgttcccaaatcccagttattgacttctgtgcactgacaggctcaacaccatgtggaagctgccaaggcttgaggcttgcaccctctgaagccatgggcctagctctacatttgcccctttcagccatggctggagccgcagagatacagggcaccaagttcctaggctgcacacagcgtgggactctggacccggcacatgaaaccactttttcctcctaggcctccgagcctgtgacgggaggggctgctgcaaagatctctgacatgccctggagacattttctccattgtcttggggattaacattcagctcctcattacttatgcaaatttctacagcctgcttgaatttctcttcaggaaatgggattttcttttctgtcacattgtcaggctgcaaattttccaaacttttatgttctgcttcccttatgaaactgaatacctttagcagtacctaagtcaccacttgaatgctttgctgcttagaaatttcttctgccagatactctaaatcatctctcccaagttcaaagttccacaaatctctaggacagggccaaaatgccaccagtctctttgctaaaatataacaagagtcacctttgctccatttcccaacaagttcctcatctccatgagagaccactttagcctggaccttattgtccatattgccatcaggcttttggtcaaagccattcaataagtctctagaaagttccaaactttctcacattttcctgtgttcttccgagccctccaaactgttccatcctctgcctgttatccagttccaaagctgcttccacatttttgggtatcttttcagcagcgtcccactcctggtatcaatttactgtattaatctgttttcatgctgctgataaagacatacctgagactgggcaatttaccaaagaaagacatttaattggacttacagttccatgtggctggggaagcctcacaatcatggcagaaggcaaagaggagcaagtcacatcttacatggatggtgtcaggcaaagagagagtgagagccaagtgaaagggatttctccccataaaatcattagatctcatgagacttattcactaccatgagaacagtatggagaaaactgccactatgattcaactatttcccaccatgtccctcccccaacaatggaaattatgggagatacaactcaagatgagatctgggtggggacacagccaaaccatattagtcaggcatataaaaacctagatattagtaggtataaaataatggttttagttagttttgaacctttggagaggaaaagatcaaaccaataatacttaaatgatgaagttagtattctttccaataataattacataaatccaatgcaagctggctgaagtaaaaaagagaatgtattagatgatataaattatgtctgtgagtagctttaggcatggatggatccagaagctcaagacatgttaccatgaccatgtctttctccatatctgaatctaggttcctcccacatggtggcaagatgtcactgcagctccaaacttaaagccaatatttttagcagcctcaagtgaaaaagcaccatttcctcaacagttgtaaaagacagggatatctttcaattgaccaagcaggatttcatgaccatctttaaattacgtatcgaatacactgattggctaggcctaggacagtgcctggaacactgggagacccgagcctcaagtcctgctgcatccaggagttgaaattagtgtctcccagataacctggtctgagagttgaggattatttctcaaggctgaacagggtactgatttaaaaaaacaaaaaattaaatggttgtgatcagcctcttagtgaaaattaagtttttgtaaatattgccctcagatttcttgagacagagacaaaggggtgaaaattggggaataaatcatacagttatttcagcttgatttaatttattcatgaagaccatcataaaatatgcaaagggaagtggagaagctgccccgtgtactataattaaacatccctactagcaagattaattatatttcctccatggtaagatttgcatcagggtgtggtcactagcgagctcttactggctacatttttgacctcagaggatctaaaggtagatttgtgtttaattgttttccattgggttgttaactgaaattaacttctaaagaagggtctatcaacagtatcagttctagatgcccgtaacaggacaaaacattatggggacacttctgactatgttgaggtgtgggtaaagtaggagaaaagagagcagaagatggaaaatggaggaaggagaaaaagcgagagtgaaatagaaaaggtgaaccttgtagaaagtgccaaaatgccaccagcagtcatcagaggggtgctttcttccacatgtccaatgacttatccttgagtaagtcaatgactatgacacaatgaatcaaattctgtttttcagaatgccagctcttaactctcttcatctcatttttgtttcttctcttgttattcatagtccttactgagcatccgtggctcccttttctctccaagacgcaacagtagggcgagccttttcagcttcagaggtcgagcaaaggacattggctctgagaatgactttgctgatgatgagcacagcacctttgaggacaatgacagccgaagagactctctgttcgtgccgcacagacatggagaacggcgccacagcaatgtcagccaggccagccgtgcctccagggtgctccccatcctgcccatgaatgggaagatgcatagcgctgtggactgcaatggtgtggtctccctggtcgggggcccttctaccctcacatctgctgggcagctcctaccagaggtgaggccaattaaaattgcagctgatgtgaagagagttgtgactggtgcaggcaggagtgtttttccatttccacatctaagaatttgttgagtttgttgcccaaaggctgggagtttgttcaatcaagctgttaactgtcttgtgaaactgttctattcagacttttctacaaagtaattaaaaacctaggttggctgtcagagaatataattagaagtaatctttcatcattattactatggtatgaaactcgccaaaaagcaaagcaacaatttatcaagcataatgtttgattaatatagttaaattaaatccaaggaaattaatgctcactaattaaataaatacttaaggattttgtgattgttgttcatttaaaaggagatttgaatacttccacttgcagtagatactattactaaatagatttaaatcccatagtacaacattgcctctctttgcaggtcagagtgttgtaacctttttagcatccactctaatgatctcaaccattgtaaatttatacatgaagagccattcaaaaagtacctggtttggaatcatgggctgtcatttttagagcagattccaatttttatattactgtcataaactcttattgtaaacaaagtggcccaaaaccaatcacatggaaaaggatttcagctacatactagacacttacagggctatattattgaaatttacttcataaaccataagaagcttttaatgttggtattaaataaaattccattagctatcaagacatattttggcaatgtcacttgattgtattttatagcattcaaaatgtcttcttatgatttttttttcacatagctccatttattatcattgaacaagctctttgagccacattaaaatgatacggagttcgttttcagttacctaatggaggagcttcttatcttggattataaaatagccattatcttcttcacattttttgcatggcctctccccacctccttctaccagagaagtgtccaggtatcctgcagtcaggttgaaccatgagaaaagtagaactttatagtggaggaaccaggaagaatgaagagaggacatcagctcttcttaaaaaatgatcatagataaccatgtaccagacactgtccagaacactgtacatgtgttaagaatcatttaagcatcataacaaccctttttgatagttagtaacattatcccaattttacagaggaggaaactgaggcttgtgcgtggtggagctaagatttgaccccaggtatgctggttactgaacctacattctatcaacagtgaaatattgcctcccactgagttatttttaatttctttaaatcaaaaagaagagatggttaaggaaataaacacataaacactttcattttaaccaatgtttctcaaaatatacttcactttcatactacttacatcagaatctcatgggaggcttcttaaaactagagattcctgtgcctacccagaccttttcagaccaaaccactgaggagaacaaggtctgggaatcttcttccttaacaagcatcccacataattcttatacataataaagtatgtttatcactgatcttgataaatgttaattgggtaaacaaaagcaaatctacaattaccatgcaggaatacagacagactgtcagtctgtcagaaattatttagcatttatcaataattatcataaatctcctgtcctatcagagatgatgggacaaatcgctgaaggcaaagttggggccagcttgaagcaaagctttgtgtggtccctttatttcctgcttcctcaacttcattctttaatcttacaatcttaagtgctttgaggcagggcactgtactattgcaaagttgagctgaaggtgcaaacaaatgaagtaggcttttggagaatgcagaggtgaaatgacaatagaaaataaatagctatgggcaaatgacacccttgaaagcacatcatttcctgtactttacacataaattcaatcgagtaatgtcattagcagttttggaatctatttgaaaattagacaaatctaggtttgtacatgtgcttctgtgtagaacagaagggactagatgatcttcatgtgactattttttttttccttaaaactttgcctctttctgacaagctgaaatattttaaattctaagaggcaccctttggattaaaagacttttatttttagagataggttatttcttttcttactaattttacttgtttttttaccttaaaattaattttagaatgacctatatgaatagttatcaccattagtgacaatcatatgcaatgagtggaaattttggttttgaatatgtatgcattaaaataattcaacttacaaaagataaaatactgctaattgttcacatcataataggatgtgaccaaaataaataatattttgatcatattattatattttgatcatattgttcttttagaaatagggaaagtcctcaaaggaatgaaactttttaatttattattaacactcagacctgcatttgaaattctttagctttacctttttttttcctgtgataattgacatcattgtttgatctcctgaagtaggaataaatttccacccatgttgaaatcctgatgagtttattctggagtaggagattatcagatcattgtatcattactaaaaatcacagtcccccacattggtattatctccttaaattatagtctcagtgccaagggtggattgttttgtggattaagttgtttttcaaatataggacaaagttatagactagttctaaaatttagttttgtaattaggaatgttgggaaatattacctgtgtctaatgaatgaaggcattttgcaactggaattcacattttaggggaactgttactgatgcatatgaaggagactttcaaacctttttgttcatatattaaactacctgaatatatgtctataaagatctaaaaactcaacctgggtgaaaattaagaaacaatatgttttggtctgaagtcctaagtgggattggctgaaatgctaaaaggttatctgtccagtagtggacctggtccctccagcccaaatccctgggatagaggcataggaaagcccaccttgacaaacccagggctccccaaaagctgaaaatctgacagacttttaaacaacccccaaagaattatcattccaacaatatcttagtgagctttttacatctgagaaagcatggtgtatatttagttaaataacacctgttgtaggaatgctttgggctttgctgctttcaaaaatagtggttatttcatctgaaattctacttctagggcacaactactgaaacagaaataagaaagagacggtccagttcttatcatgtttccatggatttattggaagatcctacatcaaggcaaagagcaatgagtatagccagtattttgaccaacaccatggaaggtatgttaaaagtcctgcgtcacagttacttggtgctttggtaatgatgaaaaaacacttcataaatttcaataaaatacttcctgacttgatattgtatcattattacacattttactaaataacagtaaaatccgtgcataactcatggattctattatcttccacagattttttttttttatatttagcctccagaaagctgctgcaaatgtaaggtatattttgaacaccactttcatacattaaattctaaacattgaaacttgtgtgcatgacgttgaaaagagtgtaatgataaatgcttatacttatgatgatgctaagccatttggattatattaactgcttgagacacaagttataaaatcctatgacttaaccagaaatataaattaaaaatgtgaattagggtttgatattaacttccttgaagcaaagtgtttaaaattttgtagtcctacttttgcctttctctgaccagattcttacaatatatcagctttctctttagttgcagattttatctgaatagttaacataatgtgtagcagtctggatctcagaatgccaaaataaagactttggggacagcttaatctgtgatcaatttctggctctgccatatgttaaatgtgttaatttgtgactttgaatttcagtctcctcatcagtaaaatgtggatgatgatgtttaggcataaggttgttgaatggattaaataagccttcttagataaaacactgatgtatttggcatgcagaagacagttaataaatattatcaatattagttgttttgttgttgttatttttgttaattcacatgtttttgcctttccatactgtaagtgaattcaaacaactgtcaacttcaactacttggaaaatattttcatgtaaaatgtattctatcccccttccttgccctcctattccctcctctccctatctctttacaaaccttctcccttgtaccccttcccaggtatgtgtgtgagtgtgagtgtgtgtagatgtgtcaagggagaagagaaaaggagaatgaaagcaaaagagagcaagcatacacgtccctttcttattgataattagattttctcttgagattggatagattcctggaataattcttttcctgtctgtatgcaaagatcccataatattattaataccaatacgaaaagcctgaaaatcacagccagaaaaaattcacagtgtagacgactgtgtacatcacagacaagtcagtattacaaaacccaattttcatagtgtcctatttcagtatcctaatgcaattcactgatttcaattgaatattaaactctagtacgttcttccccaacctcgcctgcgttagcttgcactccctcttccccccagctgccagtagcttgctcctccctgtccctccaggtaaatcttttgaagattgtctggccttccgctccttgccatagcaaaaccactgagaggaagctgccagtggttctgctaccgatgtcagcagcatgtctgctccctaaagcaggaagtagagaaggagacagggtaagtctaaatcaacagtcatgctttgcacttctgatagcattaagtttgagctaaataagacattacttaaaaaacctcaaatatccacaagattggacttgccaactaattaagatttggagttcaaaataaatgcacccacacctttctccatggaactatgtgacatggggttgcttaggatggaaaggatgttctaggaataagtgcaatctaggaagctgaagactgagagtgttttcgttttattatctgcagagcttttgacttgtgtatttgtgagaaataatggccaagtttttattctgtttttaatcagttatctagaatgaaaactgacttttctttattcaattgtatgtagacacattgagtgtgacatttgtcaaggttggttgttagcaatatcacatacatgcatactcaagcagacttaagatagtcctttttttttttttttttttttttggtttctgataatggtgcaaagttttcctggttgacataatctcttttcttggggatcctttcttctatgtctgattattgtttatttcacctttcctttttatgaaccaggcttgttgatccggttggcaatttttgttctccttctttttaactacagccaagtctccgttgtccagggtaatggatagcctcatgcttaatgaagcagtagtggataagcaaaaatgaaccatttgcgtttcaaatttttaaaagtgcaaaatcacatagaaatgttttctggtcacacctttgtgaaggatggtgggagggtgagttagaagcgcctgaagaatcaaggtgagccagcaaaagacacagatttactgtaagtgattctatgtggataacccatgcaggaataatggagatgtggctgcagttctctcctgaatgctttgctttgttttaaagtgtgagattccccccttttttttggaatgaataattgaatgattttattttagaacttaaacaactttgctccggttattcctactgtcaagatgagccacacctgctgaatttcattttttaaacttttctccagtttattttttttctatccagttcctgtttgcttctcgttatttgctaaatgacagctggcatggaaagaaaaaaccatattatggcagtatacagacaaaattaaattttgtagtttcttttttgttatttactgtaaataataatacctcctttttaccttcaatgtaaatataaggttatttgggagtttagaagtatttacaaaataactagtgcataataactatatttttctctgaattataaatcaaatattatttattgtttacaaagttatgtattaagggaaatggaaacaaactgggcacttgaagaatttcaatatccaaagagacaattgacaaatctatttttagtggaaattttaaaaacaataagcaataaattaatttacttaggaaaatagtattatagaattaattagtggcaaatgttgattagtagaagaaacattatcatctgtggttgtgattgtccttttatatgctggttccacctttacaaggtttagttcatagcaaactgtgccagatatggacagatgttccagttgccacaatagtattaaagtgactgactagagtcaactatgccatggatttaaaaagaagaaaccttccctctatttcagtgctaagaggtggtggccacattttggcagaacaggtaatagggtgtacagcaatgatattgacagaaaacaacaaattctgcatatttttccactcataagttgatgaagagattatcttgccaaaggaagatggtagacagtttttcacttcctaattccccaaatttctttgccaatattcaccaaatttcagtattttgggtgtgaccttaaagatctgtgcatttctgtcttctctcccaatgtttggttgaaattcttcttgacatcattgtacattttccttgaataaatgcattttaatataaaattttatgtcatgtttgatatgagagttatatatttaaatacatttaaataaatgtttaccatgaaaatgtatgaattatatgtatgtttcacctaaaatcctttgtatttttccagtaataaatgagttccactttgtgaaatgttgatttgtaacaacagtgaggactccagttccttaggctggggtattttctcttcttttatgccctctagttaaatgagaaatgtagagagatggaactttgttgtgtctaatatgcaagcctataatctaataaaatttaatttgagacttttaaactgagattggtgacactgacaaaattatctaattagaagatcaccaaaacatatctaatccaagaaactgacattcagtgtgactgattaaggttcttaggacatctcctgagatatctctgataacatatatacttcttgctctacctggaacatggatgagctttaagtgtatgcaatgcaagttctacccattagtttctagcagccttgaagataagtatcagacagtttagtgttgccaatagaatcttggaagctatgtttagccaggatacatttggaaagcttactagcctttctgtactgatcctttctatgacagcaaacccattgtaaaattttccctgttcctccagcagattaacccataatatcttttaacaactttagattttttaaattccttttaatttaaaccaaatctgcttaatagaaagtaagcagttttcatgaggattctaactttttttcttccagaacttgaagaatccagacagaaatgcccaccatgctggtataaatttgctaatatgtgtttgatttgggactgttgtaaaccatggttaaaggtgaaacaccttgtcaacctggttgtaatggacccatttgttgacctggccatcaccatctgcattgtcttaaatacactcttcatggctatggagcactatcccatgacggagcagttcagcagtgtactgtctgttggaaacctggtaagcctcactgagagtttctcttcctcttgaaagagtttataattgccttagtgaattttacatattgctctcaaattaaatatcaactaattggccatgtatatcttgacatcaaatgtttagcatcccttttaaataacaaaaaaatgttgctaccatagtgcaaaagagtcaaagaatttatgtacaatttgatttagaattgaatttaaattgcttatttattagaagatgattctgaattgtcctccaaggacattgatctatagcaaaattctgacatatttttaagaaccttagaataggttctttaggacatgtctgtgtttactaaacaaatgataaaatatgcccaagtcagataattttgaaatatcacttgtaagtacttgaagatggactatgtagggaggggacatcatctgggggattattattttttgtttttgtttcttctacagtcttagcaatattaaatttagaaattatttatttaattttgttaaaatatatattagcatttactggatacatattgatattataatatagtatactatagtgatagattttaaagtggtcttatacagagagacaaaatgaagaaaatcacgcaaaaaagtatatttatacaagtataaaatgcttattaagttcccagcttgataaatgaacatataagcaggttatatagagattgtaaataatacggtctaaagtataatatacaatatttttaggctctgaagtaaccactatattttcgaattatatttcaggtaggacttaactgaattaaatgataaagttggcatatgttggcctcttattttgtatcagatattggactaaatggtttacattaaatctctctctctagattcccacaaaaccagtcttaagatatttactataaattgtctgtatttcgcagttgggaaactgtatccatgagaaattaacagagaaatggaaggtctgaatgctgtatcagactctgaaagctatttcagagactatcataagctatgggcaaagatcacagacgcttagagtaggaaaggataataattttacctagttcaaatttagagctatgtaagaatttcttcaacattatttctaaaaaaaagcagggtggtggggtggcaattgaaacaagaaagcctttggaggtaatatattgtgatccaaattgaatgagcttaagcaaaaataaagggaattcattacctcactttactgaagcccatttggaactagttctaggttctaacctggctagattcaggttctcagccagcatcattgggaatcagcttcttgtctctcttcttcccaatatgtgaccttcctctctggctgggcattttcctactattgccaagattctatcaacttttattctactaatgtagctccatgtacagaaagtttgtgcctcctaactagtagctttaattaaggcccacaaattgaatatcattgacctggttggagttacatggccatttctaaaccagtcagttaccctagctcttggttttaatgccatattcgcctaaatcagaatcatatcttatcactggaggcagagtaaatgagtgaaattatgaagacaataattaggataccattaccagaaggaggatggattctagaaagaaataaacaataaatagacaactcaagctggggctggtcttacgtgttaaggaatgtaggatctgtatctaaggtgaattatggaatagtagaaaatccataggcaggatacacattcttctcaaatgcctataggatattccctaggataagttataggttaggtcataaaacacacatcaataaacttaaaaaaattaaaataatacagaatatttttctgataaaaaataaaatgaaattagaaaccaataacaagtcaatgtggaaaatcacaaatatttggaaattaaacaacttgctcttaaataaccaatgagtcaataagatgtcatgagagaaattagaaaatactttaggatgactgaaaatcaaaacaaaccaaactgaaattaatgagggcagctaaaacaatatttaaagacaaatttatactctaaatgtctatagtaaaataggagatttcccaaattgctaatttaagctcctttttaataaactagataaagaatagcaaattaaacctgaagttaacagaaaagacaaatattaaagaagagaaaaacaacagagaaaaatcaataaaaccaaaagttatttctttgaaaaaatcaacacaattgacaaatctttagttgggctaaccaagaaaaaaagaggaaagacactaattattagaagtaggaatgaagagaggatattaccatggatcttttagaaagaaaaagggagcataagaaataaaataaaattaaacgccagcaaactagataacctatgtgaaattgaaaaattcctagggagtaacaagcgcctgaaactgactcaagaagtaatagactatctcaatatacttataataagtaaacattgaattcacaattaaaaaaaagaaaacttcctgccaaaaaaagcctgagcccagatagtatcactggtgaattttgccaaatgttcaatggagcgttaacatcaatccttaacaaactgttccaacacatagaagagaagggaatacttctcacctcactttctgaagctagaattaccctgatattaatgccagacaaaaataatgcaagaaaagaacacagacacaaatatagaccagccatatcccatatgaacataggcacaacaatcctcaacaaaatactagaagccaaatcacataacatatttagatttttagattatgtactctgaataagtgaaatttatcccagtgatgcagggctggaccagcataaaaaattaatgtaatatatcatattaattttaaaaaactatacaatcatctctatagatgctgtaatcacatggaaaaagccaaagtgtttcatgataaaaacactcagcaaacttgaaatagaaaagaacttcagcctgataaacaccatctcaaaagaccccacacctatcatcattcttaatagttactttagatgcttttatcttcaggtcaagaagaaggcaaggatatttgctcttgctacttcttttcaatattgtactgaaagttctaaccagggaaataagacaagaaaaagaaattaatggcatctagattggaacacaagaagtaaattctattaacgaatacataatcttgtatttagaaaatcctataaaatacacacacacacacacacagctgttagaactaataaataagattgcagaatacaagatcaatatacaaaactcaattatatttctaaacactactaatgaacaatcagaaaataaaattaggaaaattctatttataacaacatgaaaaataataaaatacttaggaataaatttaataaaataagtgtgagatttgtacactcaaagctataaaatattgttgaaagaaattaaagaactactaaataaatgaaagcacattttatattcatagattagaggaaaatattgttaagatggcaatactcaccaaattaatctacaaatttaacgctattcatatcaaaatcccagctacctattttgcagaaagtgataaattgactgtaaattttatatgaaaatgcaagagactatatgccacacaatcttaactagaaaaaaaataaagttggagaactcaaacttccaaattttaaaacttactacaaagcaaaagtaagcaagatagtttggtactggcataaggatagctatatacatcaatggaataaaattgaaattccaacagtaagtcttcatatttatgttaaattaattttcaacaagaccactagacaattttattaaggaaagaagccttttcaacaaatggtgcttggacaagtgaatatccacatatgaaagaatggaattgaacccttacttaataacatatataaaaattaagataggtcataggcctaaaggtagagctaaaactatgaactgttagaaggaaatttagaagtaaatcttcatgacctattattaagcaatgatttcttagatatgataccaaaagcacacacaatagcaataagaaaaaaaaggttcattggactttatcaaaattagaaactttcatactgcaaacaatatcatcaagtaaaaagacaacttaaagaatggaagaagacatttgcaacccagatatctgatcatgatttgtatctaatatatgtaaaggattattataactccacaacaaataaaatagataactcactaaaaatgatcaaaatatttgaatagacatattgaaaaaggagttagacaaaaggccaataagcacataaaagatggtcagcgtcactggctaattttaggggaaaggcaaatcaaaactaaaatgagataccacttcacacacactaagatggctataatcagaaagaaagccaataccattttttatcaaggatgtggaaaaattagaatggttatgctttactttgagaatataaaatgatgcagtcactttggataataatttagctgttccccaaaaagtttggggtagagttaccacatgacctggcagttttactaatttcttcggatatatatatctaagagaattaaaaacatatttcaacatgaatgcttatagaatattattcataatactaaaaattaaaaacaattcaaatgtctatcacttgatgaatggataaacaatatccatccaataaatgttattcatccataaaaaagaatgaagtattgctacaatctacaacatgaataaaccttgaatatattatattaagtgaacaaagccagtcacaaaatttacatatcatattgctacatttatatgaaatgttcataacaggcaaatccatagagacagaaaggagatgagtggttgccaggcagtagggattagggtaaatgggagcaacaactaactaatgggtatgcagcttctttttaaggcgatgaaaatgttctaaaattcaataatggtgatgattttacaagtctgtgaatatattacaagccactgaattgcatactaatatttcatagtatgcatgtatcactattttttcttccaatcacctattgatggatgttcaagttgattccagatactttacccccatgttgcagtaaatgttcttgtatatatcacctttcataatgctgtattaacttctagaagatagatttccaggattgaagtattcccaatattaaacatattcatgtcacataaaaattagatgatatgcaacgaaatagggaaatgtgactcatagttaatagattaaagcggtacatagaaatagatctggacaggaacaaattgttagaataaacaaaaaaggactttggaggcactattgtaaatatgttgagcaatttaaaggaaaaaaaggggtcataaggaataaacagagaacatgagcagaaaaaaatgaaaactgtaaaaaggaataactcagacattttataattgaaaagtacacattctaatatgaaaaattcactggatgtgtttaaaacaaaattgcagatgtcagaagaaatagttgttaacttggagcacattaatagaaattatccaatttgaacactagagaattaaaaggaaaaatgaactgagtctaactataatatgggataatatcaagtagtctaaatatttatataatgggagaatcagaaggagaaaatagaaagaatggaacagagcaaatatttgaagaaacaatggccaaaaatttcccaaagttggtgaaaaatagtaacttacagaccttaatgttaccttataaaatgttagtgaacatcaacaggataaatataaagtaagccatacttaggcacatcttagtcatgctgctgaaaacaacaataacaaaaagctttggaaacaaccggaagaaaaatatttactatatacatgagactaatgtcttaccagaaataattcaggccagaagaaagtggccagataaaataaagaaataaaagcccattattctacagaaagtgaaactatccatcagaaattaaaatgaaataaagaattttaagataaacaaaaacctaaaaaagctgttaccaccagaactacactacaagaaatgttaatggaagttctttaggccgaataggaaaaatatcagatggaaatttgtttctgggaatgatggtcactagatatgaataaatgtgggtaaatacgaaagactatctttttttccttaatttttttcacatttattttaggttcaggggtatgtagacagctttgttgcataaataaattgtaaatcacaggggtttggcatacagattatttcatcatccaggtaataagcatagtactctatagatagttcttcaattctcatcctccttccaccctccaccctcaagtgtctgttgttcccttctttgtgttcctgtgaactcaatgtttagttcccacttataagtgagaacatgcagtatttggttttctgttgctgtggtaaattttttaaaaagacaactgattgtttaaagtggggatttataacataggtaagtgtaaaattatgaaaagatttgaacttttttttttttttttgagacggagtctcgctctctcgcccaggctggagtgcagtggtgcgatctcggctcactgcaagctccgcctccccggttcacgttgttctgctgccttagcctcccgagtagctgggactacatgcaccagccaccaagcctggctaattttgttgcatttttagtagagacggggtttcatcgtgttagccaggatggtcttgatctcctgacctcatgatccgcccgtctcggcctcccaaagtgctgggattacaggcatgagccaccacgccgggccagaacattttatctaaagtgttacaatattaattttacatagaaaattacaagaaagtatccctcatgaacacagaagcaaaaaatcattagcaaaatattatcaataaaatctagcaatagagaaaaaagtaataaatacttcttaaacatgtggggattatctcagaaaagtaagattcatttaacatttgaaaagtgatcaattaattggccatattacctctaaaagaataaaggaaagcctaagatcatctcaatagatgcagaaaaggatctgacaaaactcaacagtcatttgtgagaaaaactgtcagtaaactaggaatagaaagtagctatctcaagttgttaaggacgtttcagaaaaccctacatctagccgggcgtggaggctcacgcctgtaatcccagcactttgtgaggctgaggcagtggatcacttgaggtcaggagttcgagaccagcctggccaacatagtgaaaccccgtctgtactaaaaatagaaaaaattagctgagcgtggtggcaggcgcctgcaataccagctaacagggaggctgaggcaggagaattgcttgaacccgggaggcggaggttgcagtgagccgagattaagccactgcactccacacttcagcctgggcaacaagagtgaaactctgtctcaaaaaaaaaaaaagaaaaagaaagaaaaccctacacctaatattttacttatcagtgaaatgttgaggtagtgaattcttgccccttagaaaaattgagtgctttccccttaacatagacaaatatgtctatttttaccatttttatttgaccttgcactggaagttttatcaactgaactaaaggaaaaaaaaacaaaacaaataaaatgcataaatattgaaatgtggtaaattatctatttcatcaacatgatcatattgtagacaatcctaataaatctttaaaactgattagaaataaacgcgatattaaatattttatttaccataatatcaaaaaacacgaagaatatagtaataaatttaacaaatcatttcgagacacctattactaaaaacctcaaaacatggctgagaataattacagaagatttaaacaaatggaaatatatatgccatgttcatgcaatggaagattcaatattattaagaaattaattctacccaaatgtatctatcaattcaacccaatcccagtaaaaatgtcacagattttctttgtagaaattgatgaactgactttctatgcaaatacacagtgcttaaaattgccaaaacaatactgataaaagaataatgaaaacattaacctacctgacttcaaggcttgttataaagctgtactaatcaagaatctacagtattggcataaacaaagatatcaatggaacataatgctgagttcataaatagatccaaactacatgtcaatggattttttgaaataaacactacagaaaggaaatagaagaaaggaagtgttttcaacaaaatatcaggaacacataaataaatgtatggaaaataaatgaacctccacttcgatcttatgccaagtgccagaatcaataaggattgtagactaagcagaaaagctaaatcaataaaacatctgaaataaaacacaggagaacatctttgagaccttggggtaggcaaaaatttattggaaaacagacaaaaagtgctatctattatttaaatgtccatgaaatttcaaacaatggagacctactgaacaaaaaagaaaagtctagtaatatacacatgggtgaatttcaatttgaagtattcaagtaatatttggaaaagtcactaagactgtcaggtctctgaggtaaccacctaggtagagagagattccatttactgagttagcaaatatcagaagagaagcaaaactgtggagaaaaagcagtaagatgaattttggacctgttgaatttgagatgcctgggagatagtctttcaaatgtaggtattgaataggcaggtgggtatgtatttctagagactaggaggtatgcttgaacagaaaaatagattttgaaatatgaactattataaaaatgtaacttattataaaaggaaaactaaagtaagaggggtctagacagagagagttctgaataaatccagtatcaaatgatttgttagaggaagaaaatcaggtgagtagcatccagggaggtgtggatcacagaagctaagggcagaaaatatttcaatgaacaaggaacagaaaacaatgcctgaaacttctaaaagggcaagcaagcaagataattgtttaaaaaatttcgtttggatttattggtgatgtcggtcttgttggtgaagtttgttaaagccatttggtgggttgtggagtaaggtgaagaaatggaactggcaagtgtagacaagtatgcaatcttcgaaagaaatctggccataaggaaaggatagatggtggcacctggaaggggaaatagagtgcaaggagagtttctcttatgacagtggtgatatatatattttttgtttgtttgtttgttttttgagacggagtcttgctctttcgcccaggctggagtgcagtggcgctatctcggctcactgcaagctccgactcccgggttcatgccattctcctgcctcagcctcccgagtagctaagactacaggcgcccgccaccgcgcccggctaattttttgtatttttagtagagaagaggtttcaccgtgttagccaggatagtctcgatctcctgacctcgtgatctgcccacctcggcctcccaaagtgctgggattacaggcgtgagccaccgcgcccggcccacagtggtgatatttttaagggagagaaggactcggtaactgttactttctataaagaaacgggaagtagccagtagtagaaatgttggttaattgagaatgaattccttgcaaagtccaaaggaaaacacataacacaatttgagagattagctcaaaacaggggcacttctttcattttaacaagaagagaaaggcaaagcacagttacggatgtaagtagtctagtagataaagggaaacaaagttcaggctggctgactttcatcacctctaagacgctgaagtactgagactgtgcttctcagatgggaaggcataagcaaaaatggctgaggttatgtgcagaagagaaagtttgaaatagttttagataatagaaatggagaaaggaaaatactgcttccctttcgccaacaaaaggaaatttttttaagagttcttactatctgtagagctagccgtgagcatgtttattacagcttacatgacatcttagcaccagtctcatctgcagggccaagggaggggaccaatccatttggcttggtgatggaagcccgcactgctaggtaatcatttggtaagtttttggagggctagaaagatcagagacagagccaaacagttgatcacaatgagtcagttgcacctttcatatgaaaataatattaattttattgacttaatccgtgtactctttatcatttgataaacattatatatagtgaacaattattgatttgaatgcaaagcatttgtagatactaagttgttggacctaaaccaattttttaaaatcagaatttaatttatatttgttgggagtaaattaagttgctcaataattattcgtgtttcaagagtatttgctcatataatgaactacacttctcatttaggtcttcacagggatcttcacagcagaaatgtttctcaagataattgccatggatccatattattactttcaagaaggctggaatatttttgatggttttattgtgagccttagtttaatggaacttggtttggcaaatgtggaaggattgtcagttctccgatcattccggctggtaaattaactgggagtgttcataaaatgtactttgtaattaattagtcttcattctcatctagtaaaaatggcaagatttcccatcattataatattatttgaatacacttctaaaacaaattggattgccataccaccaaatggtagtttcttcttcatcatagctttaataaagttcacttaaatgaatagtctacacttctcttcttagttattgaatggaaggctaatagagaggaggaaacagggagtcacagataaactcgaatcacaattaaacaacaccatagtcaactctcagttatctgaggtttgcataactgcgtacaaagcttccttgggacctaggatgagctcccctttctgccaggaactaaagaattatggaattgttcattgctcaccttgtccccgtagaggaaagagttaagacaggggatagtgtacaaaggagaaggataagcaaacagagctccccatatgactgctgccacatcagaaaatcaccaaatcactctttgaaagagttaactgtactatattttgttaattttaaagaaagtatctttctttgatcttttataaaaactattagatcttaaaattcagagataaaatatcacttgacacatttccagtgaaagtttgatatgttttgttatactattactttgagttggctctaagttagtgatttattttcaaataacagaggctgtacacggttactaaggacacgttcctatagatgatttaccttagtagtgattaggctgaagactttttcatgaaatctgtttacaatttccctttctgctttcaatgttcaaatttgagttgtaatccttagaactatatttccttccctaatcctcaaagatagttatgaatctaatttgaatctagaaggatgcaaaaaacagaacaaaaatttaaaatgataaaacaagtaatatgggcaagaacttaaaaaaatatatttagtaaaccttcatgatagtgtgatgcagttaagggaaataggaagcatagtatcactagaatcttacttagtgtgtcaggctcttttgcataaattattctctggaataaattaaatactttggtgcatgtatttactcctttgggtcactttgatgccattaaataatgcactactttcagcctgacatttactgaagcatcagaaataaaatgctgctgctctttaaccataaatggtacttcagtgaactctaaagctaatacaaccaatatgtcaaacacaatgagaaagacatttacacactacactgaattaagtctatgaagatataaaggttaaaaagaagcctagcgttttacttaagtttaagtatttttgtatttgaatataatatatgtttaaaatatagcctaaagttacagcaagctaaagatatagctagattaaaacaatctaaagacaaagaaattagttcatttctgcttccactttatgtaatttaagtgttgatattattctcacctgtgcatttcagcatatttaaagtacactgaaaactatatctgctttggccttttaaaaataatgagagttcctacttctctgaaactggatctctgctaattaaccaccattaatctgaaatatcttaattccttaaggagaaacaaaagtgtatattacatatgcttatgtaggatacttgaaaatttggtgtatcttattaaactgccaatttaaaaactgtataatttaattatttcatttacagtatggaccatttcaaaatgaaaaaaagaatgctctatggtagcaagtcactgctatatttgttagtgatcatttgacaaataaataattcatcattctataattgagacagttacctgtacatttgccctgttaataaaattacagatttttcccttcctgtgtccatgtgactaacctgcacattgtgcacatgtaccctaaaacttaaagtataataataataaaataaaataaaaataaaaaataaaaaaataaaaataaaataaaattgcagatttttttagaaatgcagagcattaacactgttcttgcttttatttccagctccgagttttcaagttggcaaaatcttggccaactctaaatatgctaattaagatcattggcaattctgtgggggctctaggaaacctcaccttggtattggccatcatcgtcttcatttttgctgtggtcggcatgcagctctttggtaagagctacaaagaatgtgtctgcaagatttccaatgattgtgaactcccacgctggcacatgcatgactttttccactccttcctgatcgtgttccgcgtgctgtgtggagagtggatagagaccatgtgggactgtatggaggtcgctggccaaaccatgtgccttactgtcttcatgatggtcatggtgattggaaatctagtggtatgtagcaaaaacattttcctcattttcattaaaagataatgtaatcattaaaaagtgtgttcaactgaagaatattttgtattttttaaatcaaggccacttcctattgtctattactcatgactgtaagagccatgtatagtttagaccattgtaatccacacaaacccttaaactaccttttgaaccaaagttattctttctttcattatccttcttgctacaaggagagaaacttttctgttatttatctttcagttcttgtactagagcatggaagtgttacttagaacactcattttatttataagtactagcaataacacctgaaaacgtttcagatttggttttctacaaatttaaaaactagcaacaatctcagtttattaagagctcatggggttttcggtgcctagaaactatggtatgagcaagtaacattgtctctaaaaacattaattgtcatttctgcataaaattaaccacccctaacaccatatatatttaggatagttagctcttcttgttgcattgatcccttttaccattatgtagtgtctttctttgtctttttttaatctttgttggtttaaagtctgttttatcaaagactaggattgcaaaccctgctttttttttttctttccatttgcttggtaaatattcctccatccgttttttttgtgcctatgtgtgtctttgcatgtgagatgggtcacagcacaccgatgggtcttgactctatccaatttgccagtctgtgtcttttaattggggcatttagcccatttacatttaaggttaatattgttatgtgtgaatttgaccctgtcattatgatgctagctggctattttgctcattagctgctgcggttttttcataatgttgatggtcttaacaatttggtatgtttttgcagtggctggtactggtttttccttgccatatttagtgcttccttcaggagctcttgtaagtcaggcctggtggtggcaaaatctcttggcatttgcttgtctgtaaatgattttatttctcctttgcttatgaagcttagtttggctggatatgaaattctgggttgaaaattcttttctttaataatgtttaatattggctcccactctcttctggcttgtagggtttctgccgagagatctgctgttagtctggtgggcttccctttgtgggtaacccgacctttctctctggctgccattaacattttttccttcatttctaccttggtgtatctgacaattatgtgtcttggggttgcttttctcaaggagcttctttgtggtgttctctgtatttcctgaatttgaatgttggcctgtcttgctaggttggggaagttctcctggttatcctgaagagtgttttccaacttggttccattctcccagtcactttcaggtacaccaatcaaacttagggttggtcttttcacatagtcccatgtttcttggagactttgttcgttccttttcattcttttttctctaatcttatcttcatgctttacaaatttaactcaacatggattaaagacttaaatgtaagacctaaaaccataaaaaccttagaagaaaacctaggcaataccattcaggacattggcatgggcaaagacttcatgactgaaacaccaaaagcaatggtaacaaaagccaaaattgacaaatgggatctaattaaactaaagagcttctgcacagcaaaagaaactatcatcagagtgaacaggcaacctacagaatgggagaaaatttttgcaatctatccatctaatatccagaatctacaaaaaacttaaacaaatttacaagaaaaacacaaccctatcaaaaagtgggtgaaggatatgaacagacacttctcaaaagaagacatttatgtggccaacaaacatatgaataaaagctcatcatcactggtcattagagaaatgcaaatcaaaaccacaatgagataccacttcacgccagttagaatggcgatcattaaaaagtcaggaaaccacagatgctggagaggatgtggagaaataggaatgcttttacattgttggtgggagtgtaaactagttcaaccattgtggaaaacagtgtggcaattcctcaaggatctagaaccagaaataccatttgacccaggaatcccataactgggtatatacccaaagggttataaatcattctgctataaagatgcatgcacacgtatgcttattgcagcactattcataatagcaaagatttggaaccaacccaaatgcccatcaatgatagactggataaagaaaatgtggcacatatacaccatgaaatactatgcagccataaaaaagagtgagttcatgtcctttgcagggacatggatgaagctggaaaccattattctcggcaaactaacacaggaacagaaaaccaaacactatatgttctcactcataagtgggagttgaacaatgagaacacatggacacagggaggggaacatcacacactgaggcctgtcgaggggtggggggctaggggagggagagcattaggagaaataactaatgtagattacgggttaatggatgcagcaaaccaccatggcaagtgtatatgtatgtaacaaatctgcatgttctacacatgtatcccaaaacttagagtataataataatttaaaaaaattaaccatacccaacactagtgtcctgaatcttgaaggcatggagaagttgggaaggcatgggaagataaatataacaaagtgatataacatgtactcaaatagaattaaaaataggaagtaactaatatgtgtccaaaaatatgaaaacaaagtgccatgtgtcaagtttacaaaatgtaaaccttgctttacaataggaaggttgatcagggaagtctttgtcaaagagtttggacctaaaatatatttaactgagatgtaagatttagcttggtaggaagaaagaccatcccaaacaaggaaacaaggtacccagtgactgagggatacaggacagtagactctgtgagaagtatcaggctcttatgctttaaatatgaagtaattacaccgagttgcttaattagaacccaaaccaatggaatagaaaaatgactaccataacaagtaatttaatgtatatactcttgccaggctcagtggctcacgcctgtaatcgcagcattttgggagactgaagtgggcgtttcacttgaggacagtagttcgcgaccagcctagtcaacatggcaaaaccccatctctactagaaatacaaaaattagccaggcgtgatgatgcacacctgtaatcccagctacttgggaagctgaggcacgagaattgcttgagcctgggaggcagaggtggcagtgacccgagattgtgccattgcattccagcctgggtgaaagagcgagactctgttgcaaaaaaaaaaaaaaaaaagcatatactctttagacatgatttcctctcatataaaggtaacctccaagtccccaaagatagagaaaggggaagggaaaaaggcaaagtattattttatttttattcattgccaaatttcagcctcttcaacattacttttgataattctgatctatttttaaagtaacaagaaacataaacagtgtacaatctagaattataaacagtggcttaaaacaataaacactgattacttcatagtttctgtgggtcaggatttggggaataagttagctgggtggttctggtttaggatcagtcatgaagttgctgtcgagatgttagctgaggttacagttatcttgactggggctggaggatcagcttctaagaaggctcaatctcatgattattggaaggaggtttcagttcctttttggcagttagttgaaggtctcagtttttctctgcaggaccttttccataggactgttgagtgtccttatgatatggcagctggcttcttccagggaaggtgatgtaagagagaaggcaaggagaaaatcctctttatgttctactcttgaaagtcactcttcaccacttctgccatattgtattcattagaagctagtcactaagaagagctcaagctactataatccccaagacaactttaaaatgtttgctttcagaaaagtataagatcacatagaacagaaagtgccatagggttacatagaacagaaacaaagaaaagataatataattatgttatagatttgatttcattttctctgtatgtatatttggtatatgttggaagaagaaaagaaaacgcagagaacagaatcctttatgacaacatgaatgatcagacagcaatggggaattaagaaatataagtttgggaccagattgggtagaatttaatttatgaaaaggctgactgtgcataataaaatgtattttcctttaggcaattcaaagctacagatgattttttatcaggaaagtgacagtgaaccagtgatatttttcagaaatatacgtagcaggagaatgcagaatagatttaaagaggatgaaactcagcccaccacatgttatctattagtttactgaaattaacatatctctctaatgtataaatgtgcagaaaattgaagttgaaaagagaatttcaggaaatatcaagtacttatggttgacatcagtattaatttagattgtgatgtatgcataaaaagatatagtttataaaataatcatttccatctactgggtgtaaatttaatttttgttcttttaagagagaaaaattaaaggttctcctttctttttgactatcagttaaaataacttctttgtcttgtgataacctgggtatgtttctggagtagctaaggtagtcatatatatcatgtttaccactattaaggaaatgtgcttatataacatttgcttaagactgaatgaacttgatatactcactccttactacaattcttccttcctattctcactggaaaaatgggaaaggtgtcccaaagacaaaatggcataacttccttttaacacacatgaactatcagatgtggctccacccaaatagatgtagtagtcacaatggatgggactgccagcctagtctacagacaagacagagctgggaccacaaactactgtttcccagaccaggatttttatgagccattcttagtttccagacacgatggcaagagacccttcattggttgaagataggtgctgcagaaaaagaatgtgactttctgaaaactgatagttctagaagcagagaagacaacttcctctctccctaagtgaaggtgaggcaatagcacacaggagggatgtgaaggttttggcttcctctcacaagttgggaatcaggatggagaaacaattaaaatatgtaatatgtttcaaccttgaattcaaaatggaaattatggtaacatttccattccaagaggctaatttgagacacaagaaagagttgatttcatttactgagctagcacatttgtgaaacaggattcaggatttcagtccctgagtgagcttgctgaactgttttctttcttttttttttttttttttttttttttgagacggagtctcgctctgtcgcccaggctggagtgcagtggcgggatctcggctcactgcaagctccgcctcccgggttcacgccattctcctgcctcagcctcccaagtagctgagactacaggcgcccgccactacacccggccaattttttgtatttttagtagagacggggtttcaccgttttagccgggatggtctcgatctcctgacctcgtgatccgcccgaggcctcccaaagtgctgggattacaggcgtgagccaccgcgcccggcctgaactgttttcttaaattgtcatggatcacaccaaacacctgtgccagctgttatgcgcatacccttcggtaacaaaggaagtccagaaaaagagaataacttgactcacacaaatatttctagggaaataaggtaaataaaaagatagtgttgtggaggataagttggataatagtaagtgataacagctaaactttctcaaaggttcactatgtgccaagaactgtgctgaaagccacatgaattctgtcactgaatcctttcaacaaccttgtaagctgggcactagaaaaacgattacatttattttatagatgaggaaactgaggctcagattggttatgctacttagtaggtaacagaaaatcgattcttacctagcactcgaattctaaaatatgtgctcctctatgtcaagtaatctatagaactaagataaacatgctgatgaaagttagtgtctagtgggtattaataaacgcggtttcaaaactgtgtcaccacgggtagattggctgctttaaaaaaaataaaaacttcaatggatttatgagaaagaaaagtcatatgttccagggatatttatttattttcctgacagtggaatagcattgaattgagttatcaattcataaaagatcagagaaacaattcgaaaattaatagtaaaccctattatactgactaaatatggtagcagttcaaagaaaggaagtatcggtaagagtaaacatggaatactgtttcctcacttattctgcaaacatcacaattaggagaaaagaccttgtagttagactttcaaaaaaaaaaaagcttctctacttattaactgtggtcttggacaagtcatgtaagttgtgcagaagcattttcatctgtaaaatagtaataattcctgccttatagagttgtgagaaataaatcacataaaccttgaaaatgctttgcacaataactggtatttactaagagctcaactaaaaagctggttttacttttattgttattatgatctggtattgatactgctctaggacttggctctaaggcatgtttctgaccaaaagatctcccaatctatcagtaaagctgtgcttgttttttttttttttttaaagaatccaatataatgtgatagggatgtggatgagaaatttaacaggacagaatgagaaatgggagcaggctatataaatgtcacagtaaatgacatttgtaaatagagtatttgtccagtacagaggcaatataattggctcccgccctggggaaggattgatggatgtgtatcaagaaaaatttccaaatagacaaatgacagaactttaatatactttaggaaaataagtctaggaaatagcaccaaaatagataaaataaaaattttacatgcaattttttcttcctttgtctgtttttttaatccaaataataagttcaaaagcaaattacaataaaacataattttattggtaaattccagaggcaaaggagcaggtctggtcttaatgtgattatcaggagtcatagtatagagactgacagattgtcagtacactctcaaaatcaaacgtggtcttcattggatcttacatatttttactttaaaaaaaatcaccattggttagactaacttacaactaattagacaaaggtgctgtaagcctcattagcatgatagaagcatgagaatatagcaagaatgtagaatcctttttattgaagttttacttaaaaattttcctaagattctacttttgtactacagtttgagcatccctaatctgaaaatttgaaatccaaaatgctcggaagttcaaagcttttgagcaccaacctgatactacaagaggaaaattcacatctggcctcctgtaatgaatcgcagttaaaccacagtcaaaatgttgtttcctgaactaaattattaaaaatattgtataatattaccttcaggctatgtgtatgtgtatgaaacttaaatgaattttatgtttacacatgtgtctcattctcaagacttgtcattatgtacatgcaaatattttaaaatctaaaatccaaaacacttctggccccaagcatttcaaataagggatatgcaacttgtatttactttgtgcatttgcccccctttactgctatatctttcttttgttctgtatgttatgtgtgcttaaataatcaggaattcattgatattgtcaatcaaatcctgaaaaaaaattatatgactcagtcttgtacccctgagaatgtctgatttcttcgtaagttgtctttttttttttttccacaatagtgagtttaatgtcatgaatcttttcactcattcatactggtggagcctatttttaaagacccaatttgcagactgattactgtccttattcatggcaatacttcaactccacaatctttaattcaacaataacatcataattattgtataataaccattttatagtatttctcactattgtataattatagtagccataattgtcttaataaaaattgggacttttcatccagcaataaatacgtttttgtctgatttgtccagttatctaggtacaaaaaatggtacaaaggcacaaaaataaaatcatatttaaatatattgggataattgttgattttaggaataaattatcagtgtttccggaaatccaaattacatagtcaaaatagcatctgtattaggccattcttgcattgttacagataaatacctgagactgggtaatttataaagaaaagagatttaattagctcatggttctgcagtgagcttggtgctggcatctgcttggcttctggtgaagtctcaaagagctttcaatcatggcagaaggcaaagtggagcaagcatttcacatgatgaaagcaggaacaagcaagagagaatgtgggcaggaggcactacaaacttttaaataacaacatctcatgagaactcactaacatgaggacagcaccaaggcatgagggatctgaccccatcatccaaacacctaccaccaggccccacgtctagtgctggggattacaattccacatgagacttgggagggggcaaatgtccaaaatatatcagcatcccaaataaaagggttttttttgtacagttgtctatatttatcttttggaactgagcttaatagaaatgtttcatttagcaatgatttcagtattttctgcaatgactaaaaagcaaatagtgataatagtattattttatattgaccaagcatttttatttcattcactttttttcagaatagtgtatcatgaattagcagaaatgcatgttagaataaaataaggtgtcaagaacaatcttagaaaactaatgatggaaagcaattgaagcaatagaatgttttgatcacctgtttttcctgctgtgtttcaggttctgaacctcttcttggccttgcttttgagttccttcagttctgacaatcttgctgccactgatgatgataacgaaatgaataatctccagattgctgtgggaaggatgcagaaaggaatcgattttgttaaaagaaaaatacgtgaatttattcagaaagcctttgttaggaagcagaaagctttagatgaaattaaaccgcttgaagatctaaataataaaaaagacagctgtatttccaaccataccaccatagaaataggcaaagacctcaattatctcaaagacggaaatggaactactagtggcataggcagcagtgtagaaaaatatgtcgtggatgaaagtgattacatgtcatttataaacaaccctagcctcactgtgacagtaccaattgctgttggagaatctgactttgaaaatttaaatactgaagaattcagcagcgagtcagatatggaggaaagcaaagaggtaaaaatgtttaaataaggagatattttggtgttatataattctgttgtttaaaattatcaggtgtttttaaattgcgtgtttccttcctgttaagaaaatagaaaatatctgtctagcaatatattttccatggaaaagttggtaataaataaattaatgatagattaaaatatagctagattaacaatatgctgacttatgtttccaatactgacattttgaattcttgacagtattcttgatatgaattttttcagtatttataaataattttaaatttctcaaaatgcctcaatttctccactttcttccttgtaatttgcccacaacagtgttttttgtacgtactggaaaaatatctgatgagagggtagttgcaattctcatcttgctatgttcttagttcttaattcttacgaaatacgtcataaaatagtattgtattttgtttgcacagacatatttactcaaggaagatctgattgggatcttggcttgatatttatgtatagtttatctttcctgaagtcagtcagtttttttgaagagaaggtattgatgaggaatcacactaaaaacatatttaaccctactgagctcagtgttcactgtttaaagaaacaaaaatccttaatacattatagaatgtaaaattctgaatttaccaactcagtaagtcctggtaacttaatgtattctttgatttacaagaagggtatgagcaacagaatatattttttgttttgtttgctattaacctgttgctcaataagtacagagttggaggtaaagagaggaatttaaaaccttgatatttaattgtttatacaaaaatgaagacaagatttccagtaattaaagtttgcactaactaacaaaaataacaaggaaaaacaaagattcgttccttcctcatacgaactgtttggcgaggaagataaaagcttctattcctgatgtcgggaaagaaagaatgacgacatgggggagtgtgggcactgaaaggtaaaatttaagtagcacaacatgatcatgataattaacaatcagccaaaattatgagggaaaatatagttataaaaaaagaacaaagatgggtggatcacgaggtcaggagttcgagaccagcgtggccaacatggtgaaaccctgtctctactagagattcaaaaaaattagccaggcgtggtggtgcgtgcctgtaatcccagctactcgggaggctgaggcaagagaatcgcttgaacccaggaggcagagattgcagtgagccgagatcaccccattgcactccagcctgggcaacaggatgaaactctgtctcaaaaaaaaaaaaaaagaactagctatttcagacactttttctgtatttatttgataaaattactaaagagtatgttattttccattttttcttgtttgtaagttacgtagtattgctgttagtgattaggtagaagtagatgtttaatgggaaattcagacaatctttgaatataggaaggtataaataacagggacataggtatcagtttcacaagaaataactgatgagattcaagggaaaagtaataaaaccttctgtcctggggcaaagaattactttaattggttgaacttaaatttttactaactagattattgtttgaaagttgaataatatcttaaaatcttattaacaaaattttgaacaagtgttgttacaatagttgggttatgctggaagggtggagtggcccaatttcatatacagtgtactgctcttatagaagctgaagtcggcatttataaaatagaattcggtcatttgaattttgatgtatattcccctctcattattttgaaattatgcctaatggtgaatatttccctaatagtaaaaaaagtcaatttttattttcacacatgtttagttttaggctgtcatataaactaagaatgaattatacagtatcaaacgttgaagccattggctagtttaatcttttagctaagtttcagtatcttttgaggaatgtttaacttgacatccagtcttcttaactttaagagattttacagccgtgggttttccaaaagagcgtgtattttgccttaacttaagccattatgtctgaagtaagagggaagtccagtgatgtggggtttagagtagggacatctcttgtttctcttgttatcattaagctttttgatttgttttcccattaagttagctctgagttaaatactctaaaataatatttgtgaattcagtatttcagaattggaggaagagaactgacctgccaggtggaagcagacaggattattttattgcttgagttgtggagtccttccaataccttcccagcatagagactgttacttcagtgttaacattatttggaggggtttttaattctggctttatatcaaactttctagacataaatttataaaataataaatgatgagggttatcgccgtgaaagaggttatgtgtaggttttgatctttcagaattttacctggtagctctacactaaaaaactagagaattaaaacaattattgaagaatttcagacactcgcatttgaaatagcatttcttgcctgccttctagtcatttttgtctggtcatttttctaactgggggacaggattacattgttaaatatcacaaagtagtaagaaacatcatgaggcttattaccaatcctttctaaattaattttttaattaaagaaaaaatgaggcttttttactggaatgtctaaatgaatttttttataaggcagactgagtggactcagaggttttttaggtgttcacagtaagtcctctgcaatgtctttgctaaatttgtatgattcttcagtagttttctgtagattctctagagtaggccatttaaaatcatgtcataatcccctatgctttaattttaatgttatttcgattatattaatgtaattccttttgtgattttgaatgattgttttttcttttagagtatttaataatgtggaagccatgcttgaatgactatttttcgaagtgaaatttagtagtgcgatatggtgaccttcaccgcttaccattcttacttctcacaggagtaaaatcaagctggagccatcaagaatgcagctctggtgttttttaaccagccagaggctcgtgccaccacttttacccaggttacccaagcaagttgtacatctataaatataatcagtttctaaatgacttttgactggcctgcatgttactcagctacgttccttgcccttccattggcagtaaaataaaaacatgcacagctgctattatgctgagtcatacaaagcatggtcaggcaagtctgacaaccctaacttaaaaaaaagtgatttagctgctaattttcttacatagattttaatagaaattttattcaatgaaaagtaaaagtgcatgcctttatggattatttaatttccttttaatgttacagagttttgaacatattaggagcccaaaggagaaatgtaggtgctctttgaaaacttgcaaaaatgctttttatcctctgtctttaaaaaaaagatagcccagttactgtacttaagtcttgacagttttttatttagtgtaatgtttttctgaagggtaatcttcaaattaaagcaatcccttattcatatgcaaacttcccaaaggatgttttaatgtgataataatgtaaatgaataggaatgtctgtgtttcagttgctagcagcatgggtataatatttatctgcttcattttagggaaaatggcactgctttatttaggagttgaccaacagtattttgtatttagaatataatttctttggaaagtctgtttatatttacccttaaaactcttagactgaaagaaaaggaaatcatgtcttttgtataccaaataataataataatagtgataatgagagacttatagatggtatgctccttctaaaaatagatttagagtccatcttcttcattttcttggctcctctgtgctttctctcccctctattttattgagacctgctggaaaactttctcccgaagaatattatttaaatttatcatgatccacaaactcctgtataggaaaagaatcagaaactcttgctcctagggtgtttttaaaatgaagagacttccctatcatgtgacaatagcaataaacgtaacatcattctatgggatccattagtcgaccttcatttcttaatgttgaaatcacagttttatgcacaaatatttaaccaaaatgcctaaacccaatttaatcatttttaagaaatgttaattattttgtcacttagatacagtttcctctccttttgccaataaaactataaaacagcactaatataaaagtgtagttggctatttggaagaagcaataatcatgccattcctggagcattcttttatactttggaacaaaatattccatcactggctctccagattcatgagctataatgcctcatatattggaggaatgggatgtaaaatgggatccaagatgcgtaattgtttacagttaaacacagatgcgcatatacacagggactacagataattactttttcctattatgtattaattcttcagaaaagcatgagatttaggcactttcggataatagcttgtttctcggaaagaggcaagggtagtttccttattctctgagtatcccattttgccaatttcctgtttagaaagatacttgaggcatattatccatcaacgtatctaggggattcagctggagtaaaggtggtagaatagaagctaagaaggaactggttcgtttattttcaatcctcacattatggcaatttttgatttccttgtaaaagtctatgattctccctcaggaaacattgtccacttcctaaaaaaatatactaatttctaatacaggggtttggaaaggggacaaaaatgtgcagggaaggtttgcgtaagcaatggtggaatgggttcaacagacacctgtctatgactttatcctggagaatgtgtagtcctcatgggaaagttttccagtgggatagtgattaagatggaaaaaaatgcccaaaatatctttaatataagaacaaaatgggccaaacacgtgtctttgggtcactggtaatctactgagcagtaggacatcatgacataagagttccttttgccatccgaagaaaaatatttaaaatcctattatttgtggttttaaaaatgttataatgtattcattataaacactaaaatgactttctggataatatagtatactgtgagtaattattttgattttaccatattcttttttagttctcagaaaccaaaattgtcagatatgggatacttgatttaatctgtatttgaagttttctcttttttaagtgccaattttttaattaaattaaattaaaatctctctctcttttcccaaattatatacaatatctactaattatgttttcttcgaaatgtatcttagcttcataatgagaagtgagtgtgcccatgaaaaatttaataggaagttatgttttctcttccattttctgttgtgattcattatttttgaaaataatttactttcatttgctcacatttgctgtctaaagaaaaactattcatctggcacattcatatttagtagtattattaaagcagaaagcataagttggaagtataatatctaaaaatacaaaatgaagtattgtaccttgatgtttattagatcattaagcaaaatatgattctgccctgcttaaatcatttgattataattatccagcatataaaagaatcacagtagattttcaataggaagagtcctataatattaggtatccaccaaaaacattgttcaagtaatatttccacctgaaagtaaatgattgccaatgctttttttcagagcatataaaattggctattcctatttgatctcgttattgtcctggcatccttattttgttaaattttaactaggcaagggctatgctacaaacatcagttagtccgctagtttcctgataaataagtacaggtaattaaaaagtgaacctaaatatccaaattataccaaagggacatatatagaactttttaaactggatctgcttctagccagttcatattttggtcacttactaatgtagtatttcaccataaattatgcctagattggagcatttacaggcactctttatctgaaaattcttaagtgcatgagttgtaacagtttcacatagtgatcatctcactgttctaattggtgactatgtactacagttaggttgatcgtaattatgaccttaaatgaagctgaatatttttatattcctaatttgattaattttattttatgggcttttacacattttaactgctttagtcaacatattttataatattatgacatttgcctagaatgtaattttaagaaagtcatttaattgatgttatcaagaagggttttataaatcagaatttcctgcctatgtttcaagatcattgcttaaagaaaactttttgttcatgtaatattccaatgtgtatttagctttactctacattaaaatatgttaacaactatgaatataacttgaattaatactaaagttcatggttttgaaacatggaaatcaacaatatcataagcactatcttgaacctacaatatttgattacatatctagtctactaaatgttttaaattgataaacattgggtttacttttgaatcatcaaaaagattctttagagaagcttggcagaatggggtgcagaagatctggaatccaaccactgattcgctataacttttcacaagacgataaaactcacatttccttctctaaataaatactggattggctgacattaaggatcaatgtgctgcctagattctttgttatttgtaaatcaagtaccacaagtggaaaagtattcaagtaacacatgtgacagatcctgtgctgctccgcttcagaagacagtggggaaggataagattgcattccttaaagaggccccattcatcactggagctatagatccttgtatacagagtgaaaagagggaaaacactgtcaaaatgatttagtaatagttttcctgactccacagttaaactacagttcacctcatacactcacattaggtccgaataattggcagactggttttaagacaatactcctagttctaagagttgttcgtcattgcccacacaattcagaatcttaaaagatttgtgttactctgcaattaagagaaaatattgtgtgtattcttttgaatgtgaaagtaaatatcagataggaagtgttagtagttagtggttggataaaagagtcctcgcactggtcattcattcatttacccaaaatttattaaacacaaacattggtgctagagatacaagggtgacgaaaacatgatctttcctccaaaaaattaagtctgatgagatgcattttctagaaacacaaaatacttttgaactgaaccttggaaaaagtaaaaacttgacctttcaatagataaatatttggctttaggaaaaaggtatcttaattctacatcagaactaaggtagtgcactaaaatgaaagggagcaatgttaattcttctacttttaatgtgatttaaataagagaaaatacaggaatgtcttttataatttgaaattccagagaaaatgaataaaaaagcaattaaaaaaaacacctcaacatgcttctcattttcagccaagtacagcaaactctgtttgatattctctgattttaaccttggatcaaactatttggcaaattgctaatttgaacaggctattgaaaacagacagtgtatctagcaattcattcattcattcaatacttaatgaacagcattttggcaattcaaagcctgttccttgtattgaactatattggtgtattatccatatggcctagagtacatgtgtattattcatattatccatattggtgtattatccatagggcctagagtacgtggcttctgcccccaaatgtcttacaagcatgttaaagtacccaaaatccatccaactgaaataatttgacccatacattatcaaggttcaagatgtgtgataagccatgaaaaggttggtgaatagcctagggtgcatatggtgagtgaagatggatggaagaaattaggagtccagatttattggggagactttatgaaagcaaggaatcatgattgttgcaaaatagacagtgaagaaagaaatggtgtggtggtgaaagtcttcccaaagtcatttaaagtattggcaacccagatacttggcagcaggagtgataattgatgttacaggaatcctatgtaaacttttgcacattttaatgaagattttctataatatgctgtctggtgacttctcccaatcactgtcaagggctagacttcattattttaagatgtctttcattcatttattcactcactcattcttttttttaagcaaaatttattaagacctgtaacatacttagcactgatgtaagctctgatacagtcattcagtaatgtcagcctgagcatttgcagaaccctgaatatggatcctcatttttcccttggggtcacccgaagtcttaccccgttctgtgtttacagtgtgaaccttattcttataaggaatattttttgtttcttattgtggattgtctgtacttccatcagatgtgactcagcttcagtttttctgattacctgtgttattttccaacatgttgcaagtgataagatcagtattatcaggtccctaatagcataacaggttcgtgtgaattagatatattaaaatgagaagatttttaagtcattttttagtcaattacgtgtatagaaacatagttatacttatctcagaaagattccaattcaaaggataggaaattagaaaaacatgtaatgtttcttctgagaacaaatatattcaaattttaatgacaaagatattaggattatttttctagtaatttgatatacctgataaattaaaataagaaatcatcaaccttcaagcaccttataatatataatctttgatttaacttttttggacaaattaaaaaataattctctaactcaaagcaggcagaagtatctaatatttatgcttccatcattagtatttttaaagtacaagagacaaaagcatttttaatctcatgtatatcatacatcaatattttttaagtcatcagcatcactatgctaaggaaatattttatataaagaaaattattttcataaaataaagaaaccatctttctagagaaaatccacataatcctatgcccaaatataaatataacatttacagtactgactacagcatccatcttattctagtttaacatacttcagtgtgcattttatcatgtgcttacctcatcctttttataaagtatctcttatcagctcaaccatttcctaatgttatgcactaatggtaataacattgtaacaggtccgagaatgctgtggcccaaactactctgattcctgtgtggcactcacacctggccctgcatcatttctagagcattttaagaccaggttaaagactgggatcccttcatgtatgctgatcccaagaatggaccgacctggctaaagtttattgcatttcaagatataaaacaacttctattatatttttcttttggtgatatttgatttaacctaaaggaaaacaaaagaacaactaaatattcatttctgcctgtactaacagggcaggtaagagtgccagagtaacaagtagtttccaaatgcacaatgaaacacaggagtgcattggccaaagagaatgcaaaatatcagctcttgctatatagctaacaatgtgctgctctttttggaattagaaaattatagaatatatttaataacaatctggtatatgttttcatgtcaatgaaaagtggataaatttagatggttgctgtttatgtgcatttgatcaaatcttttctgaatttgacatgaaaatacacttgtgcagctttcattggttgggtcacaattttagaataaaacaaactatttgaaaaccatttgcaaactaatgtacaaaagcaagatcgcagatgattatatgactctggcagcttacataagctttctgcaggattttctttcagaatctctatacataggctcaaacagaagttatttccgttgttagcaccatattttaaagaaaaaaaatactatggtgttgtatctaatcttgtgacccctgacctttaccaaagcggattggcattatgtttaagttcttaaattacagatcaagaaaatgcatacagaagatggggggggggcacacctaattaatttttatatttagattaaagaaaataattaaatgtgtttttttgtgggattgattttcagaagctaaatgcaactagttcatctgaaggcagcacggttgatattggagctcccgccgagggagaacagcctgaggttgaacctgaggaatcccttgaacctgaagcctgttttacagaaggtaagcaaaacaataacatatgtggtcttgagtatcctcttttctacccattttttcctatttatttaaatgtctgtttatttgtctaccatctattatctatctatctgtatctatctatctatctatctatctagtaatcatctatacctatccaacaactgtacatttatttgtttttttttgcatttgctgtttgaaaaaaaatgcaactttttaaaaggcaaagtttaatttatgtaattagatattttcatttttatgaatcatttttaactctaagaaattattaactggcttttctgtggccttctaaaatatcttacaggagagaaagccaaatcacacacatctctctttagtttaaaaattcaataaataagaaagtgagagaagtaatttattatgtactattttgtgatattataatgggtaataattgataagtgtacatttaaatttgtccttgactgaaacagctcctatttcagtcaaggtcaaatattttttattatttctgaaaaaagatagatcataaaaatgccaaaatatactatgagtcatatgatatggggcaatatgtcactggagtaatcgcaaaaggattttctgaagaaagctaaaattatgtaatttgaggtatggatcagttatatattgtaatagcaatgctgtgtatcaaaccaccaaaaaccctgggctctaagctgcttttctagttttgactcctatttccttctgtgtaactcacagactttcttgtcactaagttttacttgtatcattgtttctctattcttacagcttcattttctacatatgtctcttatatatccttcaagatctagtctcaaatccatttcctccataaagctcagaaattaaagtttaccagaaaactctcataatactttgttttgtgataattgttgctttccataactatagaattgtagacaaattgccccaacttaaaatgtacattctttgaggacaaggctatgttttacatgttatagtattacaatttgttctatgcaattttttgacaatagtagatactcaataagtatttgttgaagagcctttgatctagcaatccagaaattatacaaaggtgtttattggattgttattgataatggccagatttaaagcaaacgaagtattcaataatggtggaattgggctgggcacagtggctcacacctgtaatcccagcactttgggaggccgaggcaggcggatcacttgaggtcaggagttcaagaccagccaggcaaacatggtaagaccccatctctaccgggcgtagtggtatgtgcctgtaataccagctacttgggaggctgaggcaggagaatcgcttgaacctgggagacagaggctgcagtgcatgagccgaggtcaggccactgcactccagcccggacaatagagtgagactccctctcaaaaaaaaaaaaaaaaggtggaatagttatattaattatagtaatcatatttagagaaatattatgaaatctttcacaaatttatttacttataataaagatgggaaatagttataccattaagtgaactaatcagaattcaaatatgtaaagtgtccatatagagtggaattacactcataggataaggacaggatggaaataccaacttttggtaagtttattttctttttggttcttctattttttatatattgtgtttttgtaatgtaatccattatagtagtgctataaacataaaaataaatatttattaaacaaatgattaaaaagccatatagatgattttaagatagcttttgtaagcggaagctatcttaaaaattaatgttatttacaatgtattatcaggtaataatgtaaatgaatctcccaccaacacaaatatacctaatcaaagagtaattttttgtcttcatttttttcccacatattttagactgtgtacggaagttcaagtgttgtcagataagcatagaagaaggcaaagggaaactctggtggaatttgaggaaaacatgctataagatagtggagcacaattggttcgaaaccttcattgtcttcatgattctgctgagcagtggggctctggtaggtgatgcatgatccactccttcacctttcatctgaaatcttttccctttcccttcaatcaactcatattacccacttttaaattaaggtgtttgtaagaatgagaagaaatatgtgtgacgtgtttagcacatatgagaggcttagtaaatagcaatttttgtcactctgtctggagtagccctcgggtggaaccaaactcagatcattatggtttcttataatgtttaaagaaggatctttctgactttcagtcatcagaggcagttcttattaagactggttatgtagacatgatgtaggattatcagctaaatatcagactgaagcacgatatttccctgacccctttgcaggtgagaactagagtgcatgggtgccggtaggagcgaactccactcactcactgctccacccctcacaggagggggagcgcaggtgactgggtgcaggagccaaggcaaatgcatttgggcactgcaagagtgaactccataccggccccacaggagcgtctaggggagggtgcctgcgatccttgaagccctagaggaagtgttacagtgcccttttagctttgccatccatggatggcttaaatgttaacagttcagtggagggtcagagtgacagccttttgcacccacacttgtggtacccaagttcatgtccggcgtccaggaggaatgagtttgtacaaatgacttgaagatggtaaatacaggggattttattgccagcgaaagtggctctcagagggaagaggagctgaaaggagatggagcaggaaggtaatcttcccctggagtctggccatccccagccagactcctctccgaagctatgctgtcaagctgtccctctgatgtcaagctacttctctctaatgtccaactgtagtctctgatgtccagctgttcctcctgtctgcctgctgagttctgggctttatataggcacaggatgggggcagggtgcaccatgggtggttttggaaaaggcaacatttaagtgagaaaacagggatgtatattctcactttgggccacggttccaggcttgagggtggagccctcgccaggtacccgtcctcttctgcccagaatttctctgcctcttgttcctgtcaaaattgcttaacataaactccatgctgcaggggactcctctgtcttcttcacactgattcgctattgccaaccacagtgaatgataagaagtagactcacttaattactgactagcaaaaaaatgatggcattacaaacttatgtctgatttcattcaatgaaatgatcaactggatcaaaatattaatataatgaaaatgatatgacctattttcttaattggtgatacaaatgtggttgcattccttttactgtttcaatttaattaataactagagtgtttggtgagttgatttcattaggagaattactgcattggatctggaggcctctaaggcgaattctgatttgactaagaatcctgtgtcctgccatatactcagtttaaagaggatcagccatgctttattttctttacctttattattattattattattttttagacagtcttgctgttgcccaggctggagtgcagtggtgtgatctcgactcactgcagcctccatctcttgggttcatgccattcttgtgccttaacctcgcaagtagctgggattacaggtgtgagctaccacacctggctaatttttgtacttttagtaatagagactgggttttgccatcttggccaggctggtctcgaactcctggcctcaagagatctgcccgtcttggcctcttaaagtgctggaacgacgggcgtgaaccaccgcaccttgccagacatgctttctaaagccaagtagagagagaactatgaagtctcattagtgactagtacctttgctgtaggagctctttgttctcagttacacccagtcagtgctcaccaaattgcacaacgtgctggcacagtggctggctcctcaggggtttacagcttcagctataagcaaagcccagaaacctttaggtccttgtatggagctctggttacaagccctgattcttgttatctaaaaaagaaaatgttcctttgtctttaatccaggctgccaggttttcctgataatttttccgataagaagatcaagttagataaatagtcttttcattctggaagcctcaggagttcctgcaaatgagttacccactctttcccaagggctctggaaaattctgtcaaagggaatttccaaacgtacacccacccgcctccacacacacacagacacacagagagagggagagagacaagaaagtgagcaatgacaatcctttcctttttctgtaggctgagggacctccctgctttatatctgcattactagaggatgcattccattgagtctgcactgaatgagaccaatctactcccaggcgttccactgcctcctgatgtagagagaagcagctggcagtctctcaaaaattttaagctctttgggggtacactgagaccaaaatttaaaaattactgaaacccttggttgactgaaatgcccagtcagcagtcatttatgatcagataatgataaagtaaaattcagccatgggaaacattaaaccttccagccttaggcacctgataagagcttgcatcgtttccttttttaagaaatcatcaattagagactgtttctgatcataaaatttaatagaattttttgacttacaggcctttgaagatatatacattgagcagcgaaaaaccattaagaccatgttagaatatgctgacaaggttttcacttacatattcattctggaaatgctgctaaagtgggttgcatatggttttcaagtgtattttaccaatgcctggtgctggctagacttcctgattgttgatgtgagtatgctgcactttgctgctttattcattggcatatatgtaatagttctagcaatggtgcctgacacagtgtaggcactcagtaacactgtatcagcccaaatataaattatgtttctcatttcacagtgagaggatgcctcaaaacattttttaccaatttaaatacatatacattcatagataaaaatcaaatgccatcatactatacttattcacttaatttcaaattaatatttaaaatctcaagttatgcaaaataaaatatgaatttagaaattttgctttttgcacactcacatttcgcaaaataacttgtatttaaatttttcacaggcatctttgacattagtatgtttgtcatcactaaagcctgttgagtttaggtcacacagatgaatcattaattacaaagaaatttgaaagtccaaaaagcaagagacaccacttgatttgtatgatatagaagcaaattggctattgaccaagtagccaaagattttattaaaccacattggtgttgaaataaaataagatagagtactaaaatatgagggtttttatataattgaatatgaggcaaatctaccattaaatgtactactactattaaatgtataaaggttacatgcagaattacattaacagtctctggcaataaaggaagacaataaataatatttagaactacataagtgtggacattacaaacaatagaaaatgcaccaaaactataaccattcttttatttgtataatgggattatgcatgatactatttcttttctctattttctgtatgtacttatcataggttggtaaatccataataaaaatatctgatacttgatatatctatgttaggataaaagtatcaagtcagcactgcttgaatataaggaaactcttcagagaaatctagttgtcctgcagctaatgatcatattacccaaagtactctgatatttacctttttagatttaagaaaactattatgatagtatatgaaactgatcaacactttgccttaaatcaaatatgcttattgctcatctatttcattatgaaagatacaaatataaataagtcatttttctagtcctgcagtagcttacagttgaaaagtgaggacagctgcgtacacagtaagtcgacacctgtattacaagtgccacctctttacttgaggaaggaggaaaggcttcaatagggaagtggagtgtgagctggagcttgagagatgtgaatgctagcaggcacagctgagggaggaacacggattcgttaaaacgttggtgcatgacatgcagggcgggttccagaaacaagtagatagggtgaggtaagcctttgtaatgggatgataaggtaagaaagataagttagaaaagatctgaagaacctgagatgccatccaaggaaatttggacttattatttaatacagaggaagctattgaagaattacatatagggaagtgacaagacctgcttgttcttttagtgagggaagttaggtggaggtgagaatgacggaatagaaaggagatttatttagagatcaaaacaccaattaggagattgctgcaatgtcccagaaagagaaggcctatatgtatcttcttttccacatttagctacacaagtcacataaaactgaatattttacaacttcttttcagccagtaaatactaccccattcaaaatattttcctctgtctaacttttatctttcatcctttaacttatgcttatctctttttggttctgtcttcagagaaggtaaagtactacaggtccttatatcttaaatacagaaaagcttcacaactcatgataattcagtaactatttttcaattatctgttaaaaagggacttacaaagcctaagagtttggattttaagggaactatatgaactatgtaagacataattttacaactcattgttttctgtattcaagaggcttcactttcaaattgcatgtgcaaaattattttgaataagttgttttttgtaacaactttcaatgtgcttcacttattttccttaaaaaatatatttttcaaatatattaacaccatactcttaaaagctgtattgcatatttatttttatttatctgcttttgaaattcaggtgtactttagaacaaaatagcttatataattttaataatttttctatatgttttcaaggaaattggacatgtgtatgtcccccgaccgtttttctttttctttttagctaagactttataatttttctcaactacattagtcaactgtatgaataactaaagacaacattgttcttgcaatttctaatttatcataaaatctcaactttttttattcactaattttgtctgacctaattaatgatattatgcccttcaaactgaaatttacaaaagtcaaagctgctttttagaggcctattcctttttaaatgtgttcatgctcatattcaccagtggtttgtatagtttacttgtgtatcaaatgttactttccatttcagatctgctcaatattattagaaatgatacagaaataagttttacagatctgtagaggaagatcacatttctctctcttttttttctttacttttaattttttaaaaacatttcctaccaagaatcttgaaaaagagcacatatatgggcttcttttttataagtgttcgcagactagtatcattaacttcaccctgggaacctgtagaaatgcaaattcttaggcctttccccaaacttactaagtcagactctgctattggtgtttttaacaagacccctgggtgattttgaaactcatgaaagttcgagaattactgattcattgcatagagcaaggctgaactgtgtagacatttttatatgtaaataagaaaattgtgttgctttttctgtataggtctcactggttagcttaactgcaaatgccttgggttactcagaacttggtgccatcaaatccctcagaacactaagagctctgaggccactgagagctttgtcccggtttgaaggaatgagggtaagactgaatgccttagagtttgtcagaattattattgagagcagactgacactttgtaccatggaaatgtcaaatttatggagaatttgtgtcttacacattcatactgacatagctaatcaatcaaaaataatatttaccagatgcccataatacttggcactgctggagtcactcacagagtagtatattgccagagggattgtttctgattagctagattttcacttcttggaaaatctctatagttatgctgctgatttgaatcaagattatttatgttcacttcatttataaatgtgcaggaaatcctactcgctgtagtttaagcctaccaaatcattgctcatcatttcttcactactccgctgtgatacactttgagccttttgatgtttgaatcaggccttttagttcttaaacacaggctgaaatggctaaaaagtaggtcaactggaaatctaacgctcatttagaagggtggtacaaaagaacagaggagtttgtgctgacatttgtcgtcccctgaggcacaaaacctgagaccacataccctcaccacctagaaaatgatgatgccttgtctcagttgttttagctggttcaaagaggattttaaaaaaatgatactttttgtgatatttgaaaataagttgcttagactttatctgcatgttatagtgatactagctcatattttctaactaagaaaatagttacttagactttatctagtgttacaatcacaactagagatgaatggtgtgtgtagatgtgtgtctgtatatgcatggttacatagaaaagtgttattagcggtaaaattctttttactttaccaattagaaagaacagtttttgcagtagaaggcttaataaacaaaaggtatcaatctttcagtaccagaatactgtttatattttctgtgtggaatttgatccccaagtggtctcttttactctcaaattttggacagcaaattgtatggtttgtatgattttttgaaagtgatgttcacttctatattcatgccactgtttatactcttaattatttttggcatttgctgttagttccatcctttgaggtaaatttgctacatgtgtgttattacctcttgagaaaacattctccaatataaaattcgttgtatactcttctgatttataattttaaaattcttagttggagctaccagagtctagtttctacccaatattcaactttgaaacagatttttttaatcatttgactgttcttttaataatgtttaaaaataagtaaatatttgttgttggcttttcacttatttttccttctcatcctgtgccaggttgttgtaaatgctcttttaggagccattccatctatcatgaatgtacttctggtttgtctgatcttttggctaatattcagtatcatgggagtgaatctctttgctggcaagttttaccattgtattaattacaccactggagagatgtttgatgtaagcgtggtcaacaactacagtgagtgcaaagctctcattgagagcaatcaaactgccaggtggaaaaatgtgaaagtaaactttgataacgtaggacttggatatctgtctctacttcaagtagtaagtaatcactttattattttccatgatgtgtaattaaaatgagtctaaagtttttcttcctcataatgagatatccacctgttagaatggctattatcaaacagataaatgacaataaatgctggcaagaatgtgaagaaaagggaacccttgtacattgttggcagggatgtaaattagtatagcttttatggaaaacagtatggaggtttctcaaaaaactaaaaatagaaccactatgtgatccaacaattccattactgggtatatatacaaaggaaattaaatcaacatgtcaaagagatgtctgcactctcacactcactgcagcactattcacaatagccaaaatatggaaacaacctaattgtccatcaacagatatgtggataaagaaaagtgtgtgtgtgtgtgtgtgtgtgtacatatatgtatatgtatatatatacacacacgtatttctatatacacacgtatagatatacactgtatatgtatatatctatacacatatatagacatacacagaaacagtgtttgtgtatgtgtgcgtgtatatagaagtagtcagggaaggggcagagcctgtggcactaagaaactgagaaaatgtacaagacttttgttttcagaattactatgtccgcacaacagaaaaagtatttcaaaaagtaaatgcgcttgaatgtatttgttttcagtttaggaaactgcttctttttgtagagtgccttaaaatagtatgttcaacaatattaaaaagattttcaaaaataagccctcgtgattgatgattggtaataatcatttaaaaacttattggatgtatatatatgtgtgtgtatacacgcacacacacacacacacacccctatagacatacacaatgaaatagtattcagcctttaaagaagaaggaaatcctgtccttttatacaacattgattcacctggaggaaattaagtgaaataagccaggcacagaaagacaaatgacacatgatgtcacttatatatggaatctaaaaaacacaaactcacagaaacagaaagcagaatgacaatcaccaggggctgggggatgatgggagatgttggtcaaaggatacaaaattcaattcgacaggaagaatacattctgtagagctattgtacagcatggtgactatagttaataataatatattatatacttgaaaatagctaagtgagtagatatgttttctcatcagaaaaaaataagtataagaagcgataattatatattacttagcttgagttagccatttcacaatatatatatatttgaaaacatcattttgtacaacataaatatattcatttttatttgtcaattaaaaaatgaatatatttttgaaaagcaattaaaataaaaatgcatatacattttaggaactctatatagatgcactaaaactatataaaaatgatataatactatacaacaataaaataaaatttttcttcctctgtgtttacaaatacttccttaggcccatctgcctagattcctcttaccatgattgaactatcttttctgccccacgctggaaacatgatggttctaaaaactttattgtctccctgactatgcatttggtagcatagccaagtcctttgttactgggagtttaatctaggcactcattgttttcctcccttcctactctgaggaaagaagtgctggccccaaggggggttgaaaaggggtgtgtgtgtgtgtgtgtatgtgtccacacgcgtgtgtgtagatagagaaagagagagagactttcaaataggaaaattgctctcttgcaaatgaaaactttccaattaagactattgtgtctgctatgcactcataataattcattcagctattcaactgactgcagtattaaatctccactagctcctggacacaatccacttacacgatcctcaagactattaaaatagtcaggaaaggggaagagcctgtggcactaaggaactgaaaaaatgtacaagagttttattttcaagatcattatgtcaacggagcagaaaacaaatatttaaaaaaggaaatgcagtagaatatattgttttcagattaggaaactgcttcctcttatagagtaatcacctcaaaatagtatgatcaacaatattaagaagattttcaagaataagctgtcatgattggtgattggtgtaataatcatttagaaaagaataagtagaaaggaagcattaagataaataatgcagcatacttttgagcttgtctcatgctgctactatacacatgaaattttttcatcaaagttcatgatatatttttatataaacacatcagagtcaaagattgttcatattgtttttatgatagcatattgttacagtagatcattatttaattatatatgctaaatatccacataagatgttatagaggaatataaatttgaagtattttcaatgcatatcgcaaaacattgccccaaaagtgaatacaaatttcaagcttatttatatgcctgtattgaatacatgtcaaatagaattttgatcaattattcaatttattttctaaaattataattttgggaaaaaagaaaatgatatgacttttcttacaggccacgtttaagggatggatggatattatgtatgcagctgttgattcacgaaatgtaagtctagttagagggaaattgtttagtttgattaaatgtatatttctacaatattgtaatttagtgatattgtcaataaaataaaattatgtgcttaatttataaaacccatctatattataaggataaaatatttaatcatactatttctttcaaaattatcataggatgattttctctaatcactctgtatcttttaacatatcttttctagtatttagcaaggcacctgacacaaaactttattgtatgtattttcaaaatgagacattttatttttggctctgatagtcctggtcatttgtgcattagaagttctcacaggcaatattttttatctgtaatatatttcctccagcttttgatcttccttataataggaaggatatgactaaaaacggggacaaaaataaacaatttagtgtttctcttgggaaagtgagattaagtggtagaagggagggacttccctaatctactttatacataccagtactttgaattcttttctataattttcattaatttctcactatttaatgaggaatgaagtcacattttgaaaaaaaaaaaaaaagagattgatttctggtatgccagagcatgataataaagctcaaaatgctctttccctagcaccagcagctagctttctgagtgaagaattcctgaggtttttttttttcttttttccacttcataaaaacagagagggagcaagaaagcatgaaaagccctgcattgtatctctataagtgctatcaggaattccagttatgagatttttctgaatagtaataataatttattgattatcactattcactgtgccaaggactttctcacattatcccatttaatcctaaatgacaaccttattgtataggtgatactagctctattttactactgaagcaaagaggcttaatgcgttaaatgggaaaacaagtttttgaaccctgaccacaaataatggctcatacccactttccacagtggttcttacctttttgattaattaattcaatgctctctccaccttccttatcaatagcttatatgccatgaaacattttcagtttcttctttaataacttagcagaccttttccgctgcaaaactcctggaatttccagcacattacaaaagatgaaagccaattgagcactacatttatgaaaagttgctggatcttgaactttaattagtaaattgcatcagataaatgcaaatttaaaccaaaataaaacattatctacacacctaccagattggcaataccaaaaagtctgacaataccaagttttaccaaggataaacagcaataagaacactcgtacaatgctgataggaaaaaaaatagttaaataatcctttaaaaacagttgggtatgatcacattatttgagaaagttaaagatattttttaatactgcaattctactttgaacaacgtatcctaaagaaacttatgcacatgtttaggataatctatgtacaaaaatgaatataacttttttttgcacttgcaaaaaactgggagcaactcaaaaacagtagaaataggcaaataattgaatactatatagtgatgaaaatgaatgaataccgccatatacaaccacatggatgagccttaaaaatacaacattgagttaaagaaactagacacatactataattctacttatataaagttcgaaattgacaaaactaagcttattgttcaaaactgcatactgaggtgttaacttgaaagaaaaagcagggacatcattaccataaaagtcaggataatgattacctccagcagggatgatggagtttatgtttgagaagggtacaccaagggtttctgaagttgtagcaatgtcctgggttatggatttcacttataaaacatattatattttgcatttatgtattatgcactttcctgtatgtatattgtcttttaaaaattttaaaaatataattttacatcactgttaactaaactcacatacacaaataaaatctcatcgaagaatagcagttttacaatattcctgatattttccattttgctgtatttccttagaaacaaaattatgctggtcataatcctctaaattgatttcataacacagtgggttataacttgcatctattatcatcatcagggattggttaactgagttggttagaacaatgtcctattagacctgtgaaagcttacagctaaggcgcaaacctactatcacacagttttctaaacaaaagtggattagacaagagatagtatcattgttacagaaacagtccctactgaataggataaagcaatagattcattttcagaaaggaaagatcaacctatatacctacatgcagacctactacaatgattcttgcctatctaaagaaatgtattataccaaacccttacacttagcaattactactggccgccactgttctaagcatatttatatgttaatatagttaatcttcacaaccacactatgaggtttaagtttgattattttcatctcacagatgagaaaactgagtcagagaaagtaaatcttaaaagttttgacatagaataatgtgacgctgacatctcttttgtaagaagaggaaatctttaatttgcatgctgtgttgggaactttgcttagaaaggaaagtgcattcataatctgggcatttgttgggtgaaattgtctataatcattcagacttctatatggttatttcattttcccaggtaatgaatagtcttgcagaactcttcaataagcatgtgagatttgaaggttcataaaatctgtttagtgtttggtttattttcattccagagattaaaacatgcttagataattaaaaactcactgatgtactttttgtgaaacaagtactagatataatggttacaattcttcatattctttaggtagaattacaacccaagtatgaagacaacctgtacatgtatctttattttgtcatctttattatttttggttcattctttaccttgaatcttttcattggtgtcatcatagataacttcaaccaacagaaaaagaagataagtatattaaaacttcatccttgctctgaaatatgaactaaatatttcatactctttcctttagcctccaaaatgcaatcaccaaaaaaagaatataaaattcagaaattattttgagacatttgataatcgataagcttttaagcaattaataattcagatagcatgtttttgatatttttagtctagaaatatgactaatatggcataatttatatattgaataaaggcatctctataaatacagatattagtaacaatagaatgaaatgtgggagccaattttcacatgattactaaggtggattttatagccagcaaagaacacaattttaacaagtgttgctttcatttctttactttggaggtcaagacatttttatgacagaagaacagaagaaatactacaatgcaatgaaaaaactgggttcaaagaaaccacaaaaacccatacctcgacctgctgtaagaataacatattttcattgcctgttaaaactatattacctaaccgtttcacagcccgaatttctagaaactagttatttttgtggatttgtaacacaaagttttttaccttaacaatgggactagctagcctaaatagcttgaaaaatgtactttacatatataatatgtataaattatataatgcataacatattttatatgtaaacatataaaatacatagaaataaaatttgctatacttaagtgccagtggtatcatacaagctgatgtcattaagacacttctaataacatcaaaaataaaatacatacatacataatgtgaaaatattaaatgttctcagagtacagaggagacagatcggaataattggtacgtcacagattggcctcagtttttgtccaactctgcagattgaatggaatcattaatgaaacaggccacaggttttgcttttttctggttaaacaaaaaaaagacaaacctcatattttcccctactatcccacccttaaatgagatgatatcattctttgtagggctttttattggctcttccaggtgtacatttgccagtgatactgttcgttcagtttggctgctgcagggagttgctgccaggagaatcgctaagtttttctatcactcctgaaggactagctcatatattaagtctcagaaaatcttccccaacgtatacgtggtataaaacacttcagtgtttctcagaaatcttgactctataaatctattggtgacaatataaaacagaccgtaattaagtgttcagttggtaagccggccaataactcaaagaaaatggatagctatattgggtcaaacacaaagggtgtacaacttgagcctagtctttaggaaataatacaatttgaatgaatagagagagaagcagagaacatttactgtatgagaaaatgtatacttcatagccatatagacaaatatatcagtgcagaatagtgatgcatttgaattagtgagtagtagacactggttttccgagttacatgagacaaggttaccatacgagtctgaagaaatttgttctaattaagcaatacaaatgcaatatagttaacagaacagcctagtaatgtgaaaagaaagattttagagagtttaacctagagactggtgtggaacaatattagaggcaaaataaccctcggccatagacaagaagataaacccttacatacaagaagatagtccataatctgtgtccaaccagcaggactggaactactccaggagtgaagttagccaataagaagactcaattgggatgaaacacaggaaaagagggaggatgcaatgaaaaaactgggttcaaagaaaccacaataacccatacctcgacctgctgtaagaatagcatattttcattgcctgttatgaaacacaggaaaagagggaggatatgtaaataacagagaatctaaaatataagctagttgatattttgtgaaactgttggttccactatcatatactgaagtcatatgaaggcactgggaaaaatagtgttagagcctatgaaatgtccagactgaaataaggattttagcattgtcagaacaaaattcaattgagctctgaaacacagattcatttttgaaaaataattagaatagagaaaaaaacaaaattctcagaatgaggccttgcatacttcatcaagatataggaagaaataaatcaatgaagaaatgagcttgagtttgtttccatcaaatgacatggatttacctgtagtggtaggggtgtgtggaaaaagttcaacacattcagctagaatattatcagtgtcaatttggcaatttagcaagtaactagtaaaatccatttattcctgcattgacaatatgtactatgtagtatgctaagcatttgaacttaaatatcgaacagtatggagtctagttaatgcaacggatagtaatcaaatagtcctgccaaaaaatggaagtatcccagaaaaaaagggatactttcagctgtgagagctgattagggggaaggggctgattaatcagggaagttagggaaggctttattaaaaaaatatactagctgaggatggaaaaagaatagaaagcatcaatagccagagtgggatgagaagagccctgtagaaggggaatgaatttgtgaaggtccttatgtaggagggctggtgagactggagtgcagaaagtcaaggttcatttgggacacactgagaataaagaggttaggataagcccaaacttttctgggccttggaggccgtgttaaggagtagttttcatcctaagagcagtaagaaaccgttaacgtggacccagtcagtctgggctttgtggtgatcactcaatcagtttcacagaggccgtgtgaatacattgtagacttgttttggagctatttcagagatggtaggtagcctgaaccatagcaatgtgcagattaataaaagtggatggatttgtgagctatcaccagagtgaaatttaaaagtttgtctattaattgaatatgggaactaaagaaggaaccaacaagaatgactggtgtctttctgctttgcacaactggataaatactgatgtcatgcaggaaatgaagaagggacagaaagtggtgagaaaattggagatgctagtttgcagaatttggcaaacgagtcagagtgagagagtgagaggaaggaggaagggagagaaatgatgaatatttagaagtagcaaaataaaggtttcttaagattcagagattaggtttaaaggaaagcaaaaggaattttagagaggaaaagatcgaagacagagggaataattacggcataaaaatgcacaagatgtgggacaaggacatagtggtctagggtagctttagaaagaaaaaggggctgagtcctctaatgaatttggagtaatatatgaaaagaacatggaaattaaaataatatgaaatgcaaaaggaaacagaggagtttatttaaactgtttaaatttaatgttctaaaaaaagtaaaaatagagggcaagagaatggaaatttatgagaagtttggaattatctttggagcaaatgaaggacaaaggattgctaattgttaaatctgaagggccaagatgaagttagagaacataaatttttggtgaataagatcttcagaattatacatcttgttccagcatatttgacaccctaggatttaaatgggagaacagaacacagagactcgagactggagttgtacattgagatgtctgtctcattggacaactctatgaacagggaatctaaacagttttttattagtcatggtgatattaaaattaagaccaaatttctgcttttaagatattttgaacttactatactctaggagccatatctgagagaaaaatgatactgctcctgcttttgaggggcctcaaaacaagtggaagggaaagaaaactaaaattgaataagagcaaaccatttgcaatacaatgccatacattttatgatcaatgaaagcactcagttttctgagagcactaagtgctttaaactcaaaactgagttagaattcatgagacagagaaggagtgggggacatgtgttttagacagaatagtagacagataaactatgtaaaatgatacagtagaacctgcctaagcttctaagagtggtaggcaggaaatatcagagggtggaagtaaggggaagatgccagacttggaaagttaaactacagtaaattaataattaataaggaagggtttgaactaaaagtagacacatttattgggttgaaaaaggccctgagaagacagatccagctggagtaatagaaatctagttcagcaggccaaatacgcattcagagaaaagagcaaaacaaaatagaacaagtagtgtttgatgtccaaaaatcaccattggaagtaatagaagcctcccaatagaaagagggcagaacactaagatgtagaatccaggccactaaaagtgtcaggatctgggaaagcaagccattaggtgtatatgtagcagagtattagtcattctagttgagaaggtagagaaaggcagcccaacagaggttaagtcaagaccagatccctagattacctgagaaacaaagcagatacgtgcaaaatggaacaatacagaaaccaatgatcagaactggtttacaagttggggacttcatttcataagcaagacataaggcaattagtacttggaaataaggtccaaatagactagggcaaagattgaatatttccattgtgactttttaaaagataattttattcttacagaagagttactcataatgaatactctaatgaatctatacacagtgtcctcttgttttaacatcttatgcaaccatagatcagttctcacaactaagaaattaatcttgatataataccattaaataaaatacagaactgagtcagatttcaccagtttttccactgaagccttttctctagaatgatgatttttaaaacatcttagctgaactttaaaatgaaatttaagatgctgtagctttagtgagagaatataaagtcagaaatcagacgaaaaatttaaaaagagagaggaaaacttggagaagtatttatttattagttgcttaaagtaaaattaataccctcccaacacatgggataaaaaattttattacatgacaaatatttactaactgtccgtcataacatgatggtgttctgtgcactgagaacataatacgtgagtttataaaacctggtatcaatgtgagtataaataaaacaaatacatttgaatacagttgaatatacaatatacaaaattttcttccaagtataaaacgaaaataaaatacactactttctttaatagaatagaacattgtaataatgttccattgcatttgaccctcacataaatgctatgaggtagcattaagagataagatttgaggctgggcatggtggctcatgcctgtaattccagcactttgggaggtcgaggtgggcagatcattaggtcaggagtttgagaccagcctgaccaatacggtgaaatcccgtctctactaaaattacaaaaagtagtcgggcatggtggcatgtacctgtaatcccagctactcaggaggctgaggcaggagtatcgcttgaacccgggaggcagaggttgcagtgagccaagatcgtgccactgcactccaacctgtgcaacagagcgagactccatctcaaaaaataaaaaaaattaaaaaaaagagagagagataagatttgagatctgacatggagcttccctatttacactacttacctgctttgtgacctaaggcaagttacctcagctctccaatcactggttttgcaaggaatttttttttttgtaaaatgttgtgaggattaaagatgtgtttttataaaagctacattttttgttgctttcttaaaatcagaagaattgaattcgattttttttaaggtttctaatggaacttttacatattatttgttccagaacaaattccaaggaatggtctttgattttgtaaccaaacaagtctttgatatcagcatcatgatcctcatctgccttaacatggtcaccatgatggtggaaaccgatgaccagagtcaagaaatgacaaacattctgtactggattaatctggtgtttattgttctgttcactggagaatgtgtgctgaaactgatctctcttcgttactactatttcactattggatggaatatttttgattttgtggtggtcattctctccattgtaggtaagaagaggtgcttttattcagttaaggaatatagtggtaaaaatatgtgttttaaaactttagaggtgtttttcactaatctttctcattcatcccaaactcccaaataaaaatctaatagtccattgttttagttttagtttgccatttctctaattgcatgctgtgcttgaaatgatgagtggaatacaaggaatttatattttcagctttcatttattctcatttaatattttcatctgttctcatctcagaagacaataactgcaactttggtagaatagtcttgtacctggtcatactcctgtggtattgacagttactgctttgaataaacaatcaatccacacacatatatacataaatcatttgaagtagtcacataattcataaatatgacctcttaaataattggaatagtgtatatgtgcagttatatatataataacacatatataagtttcatgttatctttgggtgcagacagttttctgtggtttgcaatatctctttttggaagcagatagtttgtttgaaaatccaaaacagatttgttatcatcaatgatacattaatgttaggatacatacatacattaagtcctaggaatgcaaaagatttattggaaaaaatatatatatacagtgtttatgtataagatattaaatgaggtactggaagtaaatataagaagatttaagagaaggttctacctatttggggaaacagaacattcacatggaggggaaaattatatagcactctttaaactactttctttagtcgaatagaacattgtaacaatgttccactgcatttgattctcacataagtgctatgaggtagcattaagaggtaagatttgagatctgacctggagcttccctatttacactacttaccttctcagtgacctaagagaagttacctcagctctccaatctctggttttgcaaggaatttttctgtaaaatgttattgtgaggattaaatcagattatgtatatatatgcacttagcactgtgcctagcatgaagaaaagacttagtaaatgttcagtttgaccacaagaaaaagttgatattatcaccatttactcatgcataaaagcaagtgccaggattcagtcccaagtacatctgtctccaaagcctatgttttcttctgtacatcacgctgcctactcccaaataacatagaatctcagaaagtaaagaactctcatattcctgacccaaaatcatacacctttagttcttatgcaaatactagaactagtattttggacatataaattaatttctgtacttggccactgtatgcttcatgatgtctttggaccttccagggttgagtcatttttttgatagatgctttccttgaactaggaaaaatggcccttattatcttcatttaatataaagatgtaaatgttataacaccaaacataccagtttcattttgctcaacaaacattgcagattatttgcatatatacatgtacctaactgtcctgttcacattttgtaaaactaatgtacttatgtaaactttcatttgctactattaagtataacaatatttttgttatttgttgattttctacaggaatgtttctggctgaactgatagaaaagtattttgtgtcccctaccctgttccgagtgatccgtcttgccaggattggccgaatcctacgtctgatcaaaggagcaaaggggatccgcacgctgctctttgctttgatgatgtcccttcctgcgttgtttaacatcggcctccttcttttcctggtcatgttcatctacgccatctttgggatgtccaattttgcctatgttaagagggaagttgggatcgatgacatgttcaactttgagacctttggcaacagcatgatctgcctgttccaaattacaacctctgctggctgggatggattgctagcacctattcttaatagtggacctccagactgtgaccctgacaaagatcaccctggaagctcagttaaaggagactgtgggaacccatctgttgggattttcttttttgtcagttacatcatcatatccttcctggttgtggtgaacatgtacatcgcggtcatcctggagaacttcagtgttgctactgaagaaagtgcagagcctctgagtgaggatgactttgagatgttctatgaggtttgggagaagtttgatcccgatgcgacccagtttatagagtttgccaaactttctgattttgcagatgccctggatcctcctcttctcatagcaaaacccaacaaagtccagctcattgccatggatctgcccatggtgagtggtgaccggatccactgtcttgacatcttatttgcttttacaaagcgtgttttgggtgagagtggagagatggatgcccttcgaatacagatggaagagcgattcatggcatcaaacccctccaaagtctcttatgagcccattacgaccacgttgaaacgcaaacaagaggaggtgtctgctattattatccagagggcttacagacgctacctcttgaagcaaaaagttaaaaaggtatcaagtatatacaagaaagacaaaggcaaagaatgtgatggaacacccatcaaagaagatactctcattgataaactgaatgagaattcaactccagagaaaaccgatatgacgccttccaccacgtctccaccctcgtatgatagtgtgaccaaaccagaaaaagaaaaatttgaaaaagacaaatcagaaaaggaagacaaagggaaagatatcagggaaagtaaaaagtaaaaagaaaccaagaattttccattttgtgatcaattgtttacagcccgtgatggtgatgtgtttgtgtcaacaggactcccacaggaggtctatgccaaactgactgtttttacaaatgtatacttaaggtcagtgcctataacaagacagagacctctggtcagcaaactggaactcagtaaactggagaaatagtatcgatgggaggtttctattttcacaaccagctgacactgctgaagagcagaggcgtaatggctactcagacgataggaaccaatttaaaggggggagggaagttaaatttttatgtaaattcaacatgtgacacttgataatagtaattgtcaccagtgtttatgttttaactgccacacctgccatatttttacaaaacgtgtgctgtgaatttatcacttttctttttaattcacaggttgtttactattatatgtgactatttttgtaaatgggtttgtgtttggggagagggattaaagggagggaattctacatttctctattgtattgtataactggatatattttaaatggaggcatgctgcaattctcattcacacataaaaaaatcacatcacaaaagggaagagtttacttcttgtttcaggatgtttttagatttttgaggtgcttaaatagctattcgtatttttaaggtgtctcatccagaaaaaatttaatgtgcctgtaaatgttccatagaatcacaagcattaaagagttgttttatttttacataacccattaaatgtacatgtatatatgtatatatgtatatgtgcgtgtatatacatatatatgtatacacacatgcacacacagagatatacacataccattacattgtcattcacagtcccagcagcatgactatcacatttttgataagtgtcctttggcataaaataaaaatatcctatcagtcctttctaagaagcctgaattgaccaaaaaacatccccaccaccactttataaagttgattctgctttatcctgcagtattgtttagccatcttctgctcttggtaaggttgacatagtatatgtcaatttaaaaaataaaagtctgctttgtaaatagtaattttacccagtggtgcatgtttgagcaaacaaaaatgatgatttaagcacactacttattgcatcaaatatgtaccacagtaagtatagtttgcaagctttcaacaggtaatatgatgtaattggttccattatagtttgaagctgtcactgctgcatgtttatcttgcctatgctgctgtatcttattccttccactgttcagaagtctaatatgggaagccatatatcagtggtaaagtgaagcaaattgttctaccaagacctcattcttcatgtcattaagcaataggttgcagcaaacaaggaagagcttcttgctttttattcttccaaccttaattgaacactcaatgatgaaaagcccgactgtacaaacatgttgcaagctgcttaaatctgtttaaaatatatggttagagttttctaagaaaatataaatactgtaaaaagttcattttattttatttttcagccttttgtacgtaaaatgagaaattaaaagtatcttcaggtggatgtcacagtcactattgttagtttctgttcctagcacttttaaattgaagcacttcacaaaataagaagcaaggactaggatgcagtgtaggtttctgcttttttattagtactgtaaacttgcacacatttcaatgtgaaacaaatctcaaactgagttcaatgtttatttgctttcaatagtaatgccttatcattgaaagaggcttaaagaaaaaaaaaatcagctgatactcttggcattgcttgaatccaatgtttccacctagtctttttattcagtaatcatcagtcttttccaatgtttgtttacacagatagatcttattgacccatatggcactagaactgtatcagatataatatgggatcccagctttttttcctctcccacaaaaccaggtagtgaagttatattaccagttacagcaaaatactttgtgtttcacaagcaacaataaatgtagattctttatactgaagctattgacttgtagtgtgttggtgaaatgcatgcaggaaaatgctgttaccataaagaacggtaaaccacattacaatcaagccaaaagaataaaggtttcgcttttgtttttgtatttaattgttgtctttgtttctatctttgaaatgccatttaaaggtagatttctatcatgtaaaaataatctatctgaaaaacaaatgtaaagaacacacattaattactataattcatctttcaattttttcatggaatggaagttaattaagaagagtgtattggataactactttaatattggccaaaaagctagatatggcatcaggtagactagtggaaagttacaaaaattaataaaaaattgactaacattttaagttgtgcatcttttctccttcctgtccacctattgttctttttttcacttttccatttcaatttcttccttatgtattcttgatctacttttctttatatccttctatcctttccttgcgctctcagtatttttcatttaggatattctccttgtttcttttctgttcaccaaatgtcttgtttattacagcctatagatcacttagatttagatccctaaaatttgctgtcactctgtaaagtgcacctcgagataacttcgtataatgtatgctatacgaagttatatgcatgccagtagcagcacccacgtccaccttctgtctagtaatgtccaacacctccctcagtccaaacactgctctgcatccatgtggctcccatttatacctgaagcacttgatggggcctcaatgttttactagagcccacccccctgcaactctgagaccctctggatttgtctgtcagtgcctcactggggcgttggataatttcttaaaaggtcaagttccctcagcagcattctctgagcagtctgaagatgtgtgcttttcacagttcaaatccatgtggctgtttcacccacctgcctggccttgggttatctatcaggacctagcctagaagcaggtgtgtggcacttaacacctaagctgagtgactaactgaacactcaagtggatgccatctttgtcacttcttgactgtgacacaagcaactcctgatgccaaagccctgcccacccctctcatgcccatatttggacatggtacaggtcctcactggccatggtctgtgaggtcctggtcctctttgacttcataattcctaggggccactagtatctataagaggaagagggtgctggctcccaggccacagcccacaaaattccacctgctcacaggttggctggctcgacccaggtggtgtcccctgctctgagccagctcccggccaagccagcaccatgggaacccccaagaagaagaggaaggtgcgtaccgatttaaattccaatttactgaccgtacaccaaaatttgcctgcattaccggtcgatgcaacgagtgatgaggttcgcaagaacctgatggacatgttcagggatcgccaggcgttttctgagcatacctggaaaatgcttctgtccgtttgccggtcgtgggcggcatggtgcaagttgaataaccggaaatggtttcccgcagaacctgaagatgttcgcgattatcttctatatcttcaggcgcgcggtctggcagtaaaaactatccagcaacatttgggccagctaaacatgcttcatcgtcggtccgggctgccacgaccaagtgacagcaatgctgtttcactggttatgcggcggatccgaaaagaaaacgttgatgccggtgaacgtgcaaaacaggtaaatataaaatttttaagtgtataatgatgttaaactactgattctaattgtttgtgtattttaggctctagcgttcgaacgcactgatttcgaccaggttcgttcactcatggaaaatagcgatcgctgccaggatatacgtaatctggcatttctggggattgcttataacaccctgttacgtatagccgaaattgccaggatcagggttaaagatatctcacgtactgacggtgggagaatgttaatccatattggcagaacgaaaacgctggttagcaccgcaggtgtagagaaggcacttagcctgggggtaactaaactggtcgagcgatggatttccgtctctggtgtagctgatgatccgaataactacctgttttgccgggtcagaaaaaatggtgttgccgcgccatctgccaccagccagctatcaactcgcgccctggaagggatttttgaagcaactcatcgattgatttacggcgctaaggatgactctggtcagagatacctggcctggtctggacacagtgcccgtgtcggagccgcgcgagatatggcccgcgctggagtttcaataccggagatcatgcaagctggtggctggaccaatgtaaatattgtcatgaactatatccgtaacctggatagtgaaacaggggcaatggtgcgcctgctggaagatggcgattaggcggccggccgctaatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatcccccggctagagtttaaacactagaactagtggatcccccgggatcatggcctccgcgccgggttttggcgcctcccgcgggcgcccccctcctcacggcgagcgctgccacgtcagacgaagggcgcagcgagcgtcctgatccttccgcccggacgctcaggacagcggcccgctgctcataagactcggccttagaaccccagtatcagcagaaggacattttaggacgggacttgggtgactctagggcactggttttctttccagagagcggaacaggcgaggaaaagtagtcccttctcggcgattctgcggagggatctccgtggggcggtgaacgccgatgattatataaggacgcgccgggtgtggcacagctagttccgtcgcagccgggatttgggtcgcggttcttgtttgtggatcgctgtgatcgtcacttggtgagtagcgggctgctgggctggccggggctttcgtggccgccgggccgctcggtgggacggaagcgtgtggagagaccgccaagggctgtagtctgggtccgcgagcaaggttgccctgaactgggggttggggggagcgcagcaaaatggcggctgttcccgagtcttgaatggaagacgcttgtgaggcgggctgtgaggtcgttgaaacaaggtggggggcatggtgggcggcaagaacccaaggtcttgaggccttcgctaatgcgggaaagctcttattcgggtgagatgggctggggcaccatctggggaccctgacgtgaagtttgtcactgactggagaactcggtttgtcgtctgttgcgggggcggcagttatggcggtgccgttgggcagtgcacccgtacctttgggagcgcgcgccctcgtcgtgtcgtgacgtcacccgttctgttggcttataatgcagggtggggccacctgccggtaggtgtgcggtaggcttttctccgtcgcaggacgcagggttcgggcctagggtaggctctcctgaatcgacaggcgccggacctctggtgaggggagggataagtgaggcgtcagtttctttggtcggttttatgtacctatcttcttaagtagctgaagctccggttttgaactatgcgctcggggttggcgagtgtgttttgtgaagttttttaggcaccttttgaaatgtaatcatttgggtcaatatgtaattttcagtgttagactagtaaattgtccgctaaattctggccgtttttggcttttttgttagacgtgttgacaattaatcatcggcatagtatatcggcatagtataatacgacaaggtgaggaactaaaccatgggatcggccattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgatgatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaggggatccgctgtaagtctgcagaaattgatgatctattaaacaataaagatgtccactaaaatggaagtttttcctgtcatactttgttaagaagggtgagaacagagtacctacattttgaatggaaggattggagctacgggggtgggggtggggtgggattagataaatgcctgctctttactgaaggctctttactattgctttatgataatgtttcatagttggatatcataatttaaacaagcaaaaccaaattaagggccagctcattcctcccactcatgatctatagatctatagatctctcgtgggatcattgtttttctcttgattcccactttgtggttctaagtactgtggtttccaaatgtgtcagtttcatagcctgaagaacgagatcagcagcctctgttccacatacacttcattctcagtattgttttgccaagttctaattccatcagacctcgacctgcagcccctagataacttcgtataatgtatgctatacgaagttatgctagtaactataacggtcctaaggtagcgagctagcagcttcggttttgatacactgtttacagcctgcgaaggtgactcactcgtgttaataagactcttttacgg

SEQ ID NO: 21 - DNA, 197 bp, Artificial Sequence
  oligonucleotide sequence
cagcctatagatcacttagatttagatccctaaaatttgctgtcactctgtaaagtgcacctcgagataacttcgtataatgtatgctatacgaagttatgctagtaactataacggtcctaaggtagcgagctagcagcttcggttttgatacactgtttacagcctgcgaaggtgactcactcgtgttaataaga

SEQ ID NO: 22 - protein, 2009 aa, Homo sapiens
MEQTVLVPPGPDSFNFFTRESLAAIERRIAEEKAKNPKPDKKDDDENGPKPNSDLEAGKNLPFIYGDIPPEMVSEPLEDLDPYYINKKTFIVLNKGKAIFRFSATSALYILTPFNPLRKIAIKILVHSLFSMLIMCTILTNCVFMTMSNPPDWTKNVEYTFTGIYTFESLIKIIARGFCLEDFTFLRDPWNWLDFTVITFAYVTEFVDLGNVSALRTFRVLRALKTISVIPGLKTIVGALIQSVKKLSDVMILTVFCLSVFALIGLQLFMGNLRNKCIQWPPTNASLEEHSIEKNITVNYNGTLINETVFEFDWKSYIQDSRYHYFLEGFLDALLCGNSSDAGQCPEGYMCVKAGRNPNYGYTSFDTFSWAFLSLFRLMTQDFWENLYQLTLRAAGKTYMIFFVLVIFLGSFYLINLILAVVAMAYEEQNQATLEEAEQKEAEFQQMIEQLKKQQEAAQQAATATASEHSREPSAAGRLSDSSSEASKLSSKSAKERRNRRKKRKQKEQSGGEEKDEDEFQKSESEDSIRRKGFRFSIEGNRLTYEKRYSSPHQSLLSIRGSLFSPRRNSRTSLFSFRGRAKDVGSENDFADDEHSTFEDNESRRDSLFVPRRHGERRNSNLSQTSRSSRMLAVFPANGKMHSTVDCNGVVSLVGGPSVPTSPVGQLLPEVIIDKPATDDNGTTTETEMRKRRSSSFHVSMDFLEDPSQRQRAMSIASILTNTVEELEESRQKCPPCWYKFSNIFLIWDCSPYWLKVKHVVNLVVMDPFVDLAITICIVLNTLFMAMEHYPMTDHFNNVLTVGNLVFTGIFTAEMFLKIIAMDPYYYFQEGWNIFDGFIVTLSLVELGLANVEGLSVLRSFRLLRVFKLAKSWPTLNMLIKIIGNSVGALGNLTLVLAIIVFIFAVVGMQLFGKSYKDCVCKIASDCQLPRWHMNDFFHSFLIVFRVLCGEWIETMWDCMEVAGQAMCLTVFMMVMVIGNLVVLNLFLALLLSSFSADNLAATDDDNEMNNLQIAVDRMHKGVAYVKRKIYEFIQQSFIRKQKILDEIKPLDDLNNKKDSCMSNHTAEIGKDLDYLKDVNGTTSGIGTGSSVEKYIIDESDYMSFINNPSLTVTVPIAVGESDFENLNTEDFSSESDLEESKEKLNESSSSSEGSTVDIGAPVEEQPVVEPEETLEPEACFTEGCVQRFKCCQINVEEGRGKQWWNLRRTCFRIVEHNWFETFIVFMILLSSGALAFEDIYIDQRKTIKTMLEYADKVFTYIFILEMLLKWVAYGYQTYFTNAWCWLDFLIVDVSLVSLTANALGYSELGAIKSLRTLRALRPLRALSRFEGMRVVVNALLGAIPSIMNVLLVCLIFWLIFSIMGVNLFAGKFYHCINTTTGDRFDIEDVNNHTDCLKLIERNETARWKNVKVNFDNVGFGYLSLLQVATFKGWMDIMYAAVDSRNVELQPKYEESLYMYLYFVIFIIFGSFFTLNLFIGVIIDNFNQQKKKFGGQDIFMTEEQKKYYNAMKKLGSKKPQKPIPRPGNKFQGMVFDFVTRQVFDISIMILICLNMVTMMVETDDQSEYVTTILSRINLVFIVLFTGECVLKLISLRHYYFTIGWNIFDFVVVILSIVGMFLAELIEKYFVSPTLFRVIRLARIGRILRLIKGAKGIRTLLFALMMSLPALFNIGLLLFLVMFIYAIFGMSNFAYVKREVGIDDMFNFETFGNSMICLFQITTSAGWDGLLAPILNSKPPDCDPNKVNPGSSVKGDCGNPSVGIFFFVSYIIISFLVVVNMYIAVILENFSVATEESAEPLSEDDFEMFYEVWEKFDPDATQFMEFEKLSQFAAALEPPLNLPQPNKLQLIAMDLPMVSGDRIHCLDILFAFTKRVLGESGEMDALRIQMEERFMASNPSKVSYQPITTTLKRKQEEVSAVIIQRAYRRHLLKRTVKQASFTYNKNKIKGGANLLIKEDMIIDRINENSITEKTDLTMSTAACPPSYDRVTKPIVEKHEQEGKDEKAKGK

SEQ ID NO: 23 - protein, 2000 aa, Homo sapiens
MAQALLVPPGPESFRLFTRESLAAIEKRAAEEKAKKPKKEQDNDDENKPKPNSDLEAGKNLPFIYGDIPPEMVSEPLEDLDPYYINKKTFIVMNKGKAIFRFSATSALYILTPLNPVRKIAIKILVHSLFSMLIMCTILTNCVFMTLSNPPDWTKNVEYTFTGIYTFESLIKILARGFCLEDFTFLRDPWNWLDFSVIVMAYVTEFVSLGNVSALRTFRVLRALKTISVIPGLKTIVGALIQSVKKLSDVMILTVFCLSVFALIGLQLFMGNLRNKCLQWPPSDSAFETNTTSYFNGTMDSNGTFVNVTMSTFNWKDYIGDDSHFYVLDGQKDPLLCGNGSDAGQCPEGYICVKAGRNPNYGYTSFDTFSWAFLSLFRLMTQDYWENLYQLTLRAAGKTYMIFFVLVIFLGSFYLVNLILAVVAMAYEEQNQATLEEAEQKEAEFQQMLEQLKKQQEEAQAVAAASAASRDFSGIGGLGELLESSSEASKLSSKSAKEWRNRRKKRRQREHLEGNNKGERDSFPKSESEDSVKRSSFLFSMDGNRLTSDKKFCSPHQSLLSIRGSLFSPRRNSKTSIFSFRGRAKDVGSENDFADDEHSTFEDSESRRDSLFVPHRHGERRNSNVSQASMSSRMVPGLPANGKMHSTVDCNGVVSLVGGPSALTSPTGQLPPEGTTTETEVRKRRLSSYQISMEMLEDSSGRQRAVSIASILTNTMEELEESRQKCPPCWYRFANVFLIWDCCDAWLKVKHLVNLIVMDPFVDLAITICIVLNTLFMAMEHYPMTEQFSSVLTVGNLVFTGIFTAEMVLKIIAMDPYYYFQEGWNIFDGIIVSLSLMELGLSNVEGLSVLRSFRLLRVFKLAKSWPTLNMLIKIIGNSVGALGNLTLVLAIIVFIFAVVGMQLFGKSYKECVCKINDDCTLPRWHMNDFFHSFLIVFRVLCGEWIETMWDCMEVAGQTMCLIVFMLVMVIGNLVVLNLFLALLLSSFSSDNLAATDDDNEMNNLQIAVGRMQKGIDYVKNKMRECFQKAFFRKPKVIEIHEGNKIDSCMSNNTGIEISKELNYLRDGNGTTSGVGTGSSVEKYVIDENDYMSFINNPSLTVTVPIAVGESDFENLNTEEFSSESELEESKEKLNATSSSEGSTVDVVLPREGEQAETEPEEDLKPEACFTEGCIKKFPFCQVSTEEGKGKIWWNLRKTCYSIVEHNWFETFIVFMILLSSGALAFEDIYIEQRKTIKTMLEYADKVFTYIFILEMLLKWVAYGFQTYFTNAWCWLDFLIVDVSLVSLVANALGYSELGAIKSLRTLRALRPLRALSRFEGMRVVVNALVGAIPSIMNVLLVCLIFWLIFSIMGVNLFAGKFYHCVNMTTGNMFDISDVNNLSDCQALGKQARWKNVKVNFDNVGAGYLALLQVATFKGWMDIMYAAVDSRDVKLQPVYEENLYMYLYFVIFIIFGSFFTLNLFIGVIIDNFNQQKKKFGGQDIFMTEEQKKYYNAMKKLGSKKPQKPIPRPANKFQGMVFDFVTRQVFDISIMILICLNMVTMMVETDDQGKYMTLVLSRINLVFIVLFTGEFVLKLVSLRHYYFTIGWNIFDFVVVILSIVGMFLAEMIEKYFVSPTLFRVIRLARIGRILRLIKGAKGIRTLLFALMMSLPALFNIGLLLFLVMFIYAIFGMSNFAYVKKEAGIDDMFNFETFGNSMICLFQITTSAGWDGLLAPILNSAPPDCDPDTIHPGSSVKGDCGNPSVGIFFFVSYIIISFLVVVNMYIAVILENFSVATEESAEPLSEDDFEMFYEVWEKFDPDATQFIEFSKLSDFAAALDPPLLIAKPNKVQLIAMDLPMVSGDRIHCLDILFAFTKRVLGESGEMDALRIQMEDRFMASNPSKVSYEPITTTLKRKQEEVSAAIIQRNFRCYLLKQRLKNISSNYNKEAIKGRIDLPIKQDMIIDKLNGNSTPEKTDGSSSTTSPPSYDSVTKPDKEKFEKDKPEKESKGKEVRENQK

SEQ ID NO: 24 - protein, 1836 aa, Homo sapiens
MARPSLCTLVPLGPECLRPFTRESLAAIEQRAVEEEARLQRNKQMEIEEPERKPRSDLEAGKNLPMIYGDPPPEVIGIPLEDLDPYYSNKKTFIVLNKGKAIFRFSATPALYLLSPFSVVRRGAIKVLIHALFSMFIMITILTNCVFMTMSDPPPWSKNVEYTFTGIYTFESLIKILARGFCVDDFTFLRDPWNWLDFSVIMMAYLTEFVDLGNISALRTFRVLRALKTITVIPGLKTIVGALIQSVKKLSDVMILTVFCLSVFALVGLQLFMGNLRQKCVRWPPPFNDTNTTWYSNDTWYGNDTWYGNEMWYGNDSWYANDTWNSHASWATNDTFDWDAYISDEGNFYFLEGSNDALLCGNSSDAGHCPEGYECIKTGRNPNYGYTSYDTFSWAFLALFRLMTQDYWENLFQLTLRAAGKTYMIFFVVIIFLGSFYLINLILAVVAMAYAEQNEATLAEDKEKEEEFQQMLEKFKKHQEELEKAKAAQALEGGEADGDPAHGKDCNGSLDTSQGEKGAPRQSSSGDSGISDAMEELEEAHQKCPPWWYKCAHKVLIWNCCAPWLKFKNIIHLIVMDPFVDLGITICIVLNTLFMAMEHYPMTEHFDNVLTVGNLVFTGIFTAEMVLKLIAMDPYEYFQQGWNIFDSIIVTLSLVELGLANVQGLSVLRSFRLLRVFKLAKSWPTLNMLIKIIGNSVGALGNLTLVLAIIVFIFAVVGMQLFGKSYKECVCKIALDCNLPRWHMHDFFHSFLIVFRILCGEWIETMWDCMEVAGQAMCLTVFLMVMVIGNLVVLNLFLALLLSSFSADSLAASDEDGEMNNLQIAIGRIKLGIGFAKAFLLGLLHGKILSPKDIMLSLGEADGAGEAGEAGETAPEDEKKEPPEEDLKKDNHILNHMGLADGPPSSLELDHLNFINNPYLTIQVPIASEESDLEMPTEEETDTFSEPEDSKKPPQPLYDGNSSVCSTADYKPPEEDPEEQAEENPEGEQPEECFTEACVQRWPCLYVDISQGRGKKWWTLRRACFKIVEHNWFETFIVFMILLSSGALAFEDIYIEQRRVIRTILEYADKVFTYIFIMEMLLKWVAYGFKVYFTNAWCWLDFLIVDVSIISLVANWLGYSELGPIKSLRTLRALRPLRALSRFEGMRVVVNALLGAIPSIMNVLLVCLIFWLIFSIMGVNLFAGKFYYCINTTTSERFDISEVNNKSECESLMHTGQVRWLNVKVNYDNVGLGYLSLLQVATFKGWMDIMYAAVDSREKEEQPQYEVNLYMYLYFVIFIIFGSFFTLNLFIGVIIDNFNQQKKKLGGKDIFMTEEQKKYYNAMKKLGSKKPQKPIPRPQNKIQGMVYDLVTKQAFDITIMILICLNMVTMMVETDNQSQLKVDILYNINMIFIIIFTGECVLKMLALRQYYFTVGWNIFDFVVVILSIVGLALSDLIQKYFVSPTLFRVIRLARIGRVLRLIRGAKGIRTLLFALMMSLPALFNIGLLLFLVMFIYSIFGMSNFAYVKKESGIDDMFNFETFGNSIICLFEITTSAGWDGLLNPILNSGPPDCDPNLENPGTSVKGDCGNPSIGICFFCSYIIISFLIVVNMYIAIILENFNVATEESSEPLGEDDFEMFYETWEKFDPDATQFIAYSRLSDFVDTLQEPLRIAKPNKIKLITLDLPMVPGDKIHCLDILFALTKEVLGDSGEMDALKQTMEEKFMAANPSKVSYEPITTTLKRKHEEVCAIKIQRAYRRHLLQRSMKQASYMYRHSHDGSGDDAPEKEGLLANTMSKMYGHENGNSSSPSPEEKGEAGDAGPTMGLMPISPSDTAWPPAPPPGQTVRPGVKESLV

SEQ ID NO: 25 - protein, 2016 aa, Homo sapiens [sequence omitted]

SEQ ID NO: 26 - protein, 1980 aa, Homo sapiens
MAARLLAPPGPDSFKPFTPESLANIERRIAESKLKKPPKADGSHREDDEDSKPKPNSDLEAGKSLPFIYGDIPQGLVAVPLEDFDPYYLTQKTFVVLNRGKTLFRFSATPALYILSPFNLIRRIAIKILIHSVFSMIIMCTILTNCVFMTFSNPPDWSKNVEYTFTGIYTFESLVKIIARGFCIDGFTFLRDPWNWLDFSVIMMAYITEFVNLGNVSALRTFRVLRALKTISVIPGLKTIVGALIQSVKKLSDVMILTVFCLSVFALIGLQLFMGNLRNKCVVWPINFNESYLENGTKGFDWEEYINNKTNFYTVPGMLEPLLCGNSSDAGQCPEGYQCMKAGRNPNYGYTSFDTFSWAFLALFRLMTQDYWENLYQLTLRAAGKTYMIFFVLVIFVGSFYLVNLILAVVAMAYEEQNQATLEEAEQKEAEFKAMLEQLKKQQEEAQAAAMATSAGTVSEDAIEEEGEEGGGSPRSSSEISKLSSKSAKERRNRRKKRKQKELSEGEEKGDPEKVFKSESEDGMRRKAFRLPDNRIGRKFSIMNQSLLSIPGSPFLSRHNSKSSIFSFRGPGRFRDPGSENEFADDEHSTVEESEGRRDSLFIPIRARERRSSYSGYSGYSQGSRSSRIFPSLRRSVKRNSTVDCNGVVSLIGGPGSHIGGRLLPEATTEVEIKKKGPGSLLVSMDQLASYGRKDRINSIMSVVTNTLVEELEESQRKCPPCWYKFANTFLIWECHPYWIKLKEIVNLIVMDPFVDLAITICIVLNTLFMAMEHHPMTPQFEHVLAVGNLVFTGIFTAEMFLKLIAMDPYYYFQEGWNIFDGFIVSLSLMELSLADVEGLSVLRSFRLLRVFKLAKSWPTLNMLIKIIGNSVGALGNLTLVLAIIVFIFAVVGMQLFGKSYKECVCKINQDCELPRWHMHDFFHSFLIVFRVLCGEWIETMWDCMEVAGQAMCLIVFMMVMVIGNLVVLNLFLALLLSSFSADNLAATDDDGEMNNLQISVIRIKKGVAWTKLKVHAFMQAHFKQREADEVKPLDELYEKKANCIANHTGADIHRNGDFQKNGNGTTSGIGSSVEKYIIDEDHMSFINNPNLTVRVPIAVGESDFENLNTEDVSSESDPEGSKDKLDDTSSSEGSTIDIKPEVEEVPVEQPEEYLDPDACFTEGCVQRFKCCQVNIEEGLGKSWWILRKTCFLIVEHNWFETFIIFMILLSSGALAFEDIYIEQRKTIRTILEYADKVFTYIFILEMLLKWTAYGFVKFFTNAWCWLDFLIVAVSLVSLIANALGYSELGAIKSLRTLRALRPLRALSRFEGMRVVVNALVGAIPSIMNVLLVCLIFWLIFSIMGVNLFAGKYHYCFNETSEIRFEIEDVNNKTECEKLMEGNNTEIRWKNVKINFDNVGAGYLALLQVATFKGWMDIMYAAVDSRKPDEQPKYEDNIYMYIYFVIFIIFGSFFTLNLFIGVIIDNFNQQKKKFGGQDIFMTEEQKKYYNAMKKLGSKKPQKPIPRPLNKIQGIVFDFVTQQAFDIVIMMLICLNMVTMMVETDTQSKQMENILYWINLVFVIFFTCECVLKMFALRHYYFTIGWNIFDFVVVILSIVGMFLADIIEKYFVSPTLFRVIRLARIGRILRLIKGAKGIRTLLFALMMSLPALFNIGLLLFLVMFIFSIFGMSNFAYVKHEAGIDDMFNFETFGNSMICLFQITTSAGWDGLLLPILNRPPDCSLDKEHPGSGFKGDCGNPSVGIFFFVSYIIISFLIVVNMYIAIILENFSVATEESADPLSEDDFETFYEIWEKFDPDATQFIEYCKLADFADALEHPLRVPKPNTIELIAMDLPMVSGDRIHCLDILFAFTKRVLGDSGELDILRQQMEERFVASNPSKVSYEPITTTLRRKQEEVSAVVLQRAYRGHLARRGFICKKTTSNKLENGGTHREKKESTPSTASLPSYDSVTKPEKEKQQRAEEGRRERAKRQKEVRESKC

SEQ ID NO: 27 - protein, 1988 aa, Homo sapiens
MAMLPPPGPQSFVHFTKQSLALIEQRIAERKSKEPKEEKKDDDEEAPKPSSDLEAGKQLPFIYGDIPPGMVSEPLEDLDPYYADKKTFIVLNKGKTIFRFNATPALYMLSPFSPLRRISIKILVHSLFSMLIMCTILTNCIFMTMNNPPDWTKNVEYTFTGIYTFESLVKILARGFCVGEFTFLRDPWNWLDFVVIVFAYLTEFVNLGNVSALRTFRVLRALKTISVIPGLKTIVGALIQSVKKLSDVMILTVFCLSVFALIGLQLFMGNLKHKCFRNSLENNETLESIMNTLESEEDFRKYFYYLEGSKDALLCGFSTDSGQCPEGYTCVKIGRNPDYGYTSFDTFSWAFLALFRLMTQDYWENLYQQTLRAAGKTYMIFFVVVIFLGSFYLINLILAVVAMAYEEQNQANIEEAKQKELEFQQMLDRLKKEQEEAEAIAAAAAEYTSIRRSRIMGLSESSSETSKLSSKSAKERRNRRKKKNQKKLSSGEEKGDAEKLSKSESEDSIRRKSFHLGVEGHRRAHEKRLSTPNQSPLSIRGSLFSARRSSRTSLFSFKGRGRDIGSETEFADDEHSIFGDNESRRGSLFVPHRPQERRSSNISQASRSPPMLPVNGKMHSAVDCNGVVSLVDGRSALMLPNGQLLPEVIIDKATSDDSGTTNQIHKKRRCSSYLLSEDMLNDPNLRQRAMSRASILTNTVEELEESRQKCPPWWYRFAHKFLIWNCSPYWIKFKKCIYFIVMDPFVDLAITICIVLNTLFMAMEHHPMTEEFKNVLAIGNLVFTGIFAAEMVLKLIAMDPYEYFQVGWNIFDSLIVTLSLVELFLADVEGLSVLRSFRLLRVFKLAKSWPTLNMLIKIIGNSVGALGNLTLVLAIIVFIFAVVGMQLFGKSYKECVCKINDDCTLPRWHMNDFFHSFLIVFRVLCGEWIETMWDCMEVAGQAMCLIVYMMVMVIGNLVVLNLFLALLLSSFSSDNLTAIEEDPDANNLQIAVTRIKKGINYVKQTLREFILKAFSKKPKISREIRQAEDLNTKKENYISNHTLAEMSKGHNFLKEKDKISGFGSSVDKHLMEDSDGQSFIHNPSLTVTVPIAPGESDLENMNAEELSSDSDSEYSKVRLNRSSSSECSTVDNPLPGEGEEAEAEPMNSDEPEACFTDGCVWRFSCCQVNIESGKGKIWWNIRKTCYKIVEHSWFESFIVLMILLSSGALAFEDIYIERKKTIKIILEYADKIFTYIFILEMLLKWIAYGYKTYFTNAWCWLDFLIVDVSLVTLVANTLGYSDLGPIKSLRTLRALRPLRALSRFEGMRVVVNALIGAIPSIMNVLLVCLIFWLIFSIMGVNLFAGKFYECINTTDGSRFPASQVPNRSECFALMNVSQNVRWKNLKVNFDNVGLGYLSLLQVATFKGWTIIMYAAVDSVNVDKQPKYEYSLYMYIYFVVFIIFGSFFTLNLFIGVIIDNFNQQKKKLGGQDIFMTEEQKKYYNAMKKLGSKKPQKPIPRPGNKIQGCIFDLVTNQAFDISIMVLICLNMVTMMVEKEGQSQHMTEVLYWINVVFIILFTGECVLKLISLRHYYFTVGWNIFDFVVVIISIVGMFLADLIETYFVSPTLFRVIRLARIGRILRLVKGAKGIRTLLFALMMSLPALFNIGLLLFLVMFIYAIFGMSNFAYVKKEDGINDMFNFETFGNSMICLFQITTSAGWDGLLAPILNSKPPDCDPKKVHPGSSVEGDCGNPSVGIFYFVSYIIISFLVVVNMYIAVILENFSVATEESTEPLSEDDFEMFYEVWEKFDPDATQFIEFSKLSDFAAALDPPLLIAKPNKVQLIAMDLPMVSGDRIHCLDILFAFTKRVLGESGEMDSLRSQMEERFMSANPSKVSYEPITTTLKRKQEDVSATVIQRAYRRYRLRQNVKNISSIYIKDGDRDDDLLNKKDMAFDNVNENSSPEKTDATSSTTSPPSYDSVTKPDKEKYEQDRTEKEDKGKDSKESKK

SEQ ID NO: 28 - protein, 1988 aa, Homo sapiens; identical to SEQ ID NO: 27

SEQ ID NO: 29 - protein, 1791 aa, Homo sapiens
MDDRCYPVIFPDERNFRPFTSDSLAAIEKRIAIQKEKKKSKDQTGEVPQPRPQLDLKASRKLPKLYGDIPRELIGKPLEDLDPFYRNHKTFMVLNRKRTIYRFSAKHALFIFGPFNSIRSLAIRVSVHSLFSMFIIGTVIINCVFMATGPAKNSNSNNTDIAECVFTGIYIFEALIKILARGFILDEFSFLRDPWNWLDSIVIGIAIVSYIPGITIKLLPLRTFRVFRALKAISVVSRLKVIVGALLRSVKKLVNVIILTFFCLSIFALVGQQLFMGSLNLKCISRDCKNISNPEAYDHCFEKKENSPEFKMCGIWMGNSACSIQYECKHTKINPDYNYTNFDNFGWSFLAMFRLMTQDSWEKLYQQTLRTTGLYSVFFFIVVIFLGSFYLINLTLAVVTMAYEEQNKNVAAEIEAKEKMFQEAQQLLKEEKEALVAMGIDRSSLTSLETSYFTPKKRKLFGNKKRKSFFLRESGKDQPPGSDSDEDCQKKPQLLEQTKRLSQNLSLDHFDEHGDPLQRQRALSAVSILTITMKEQEKSQEPCLPCGENLASKYLVWNCCPQWLCVKKVLRTVMTDPFTELAITICIIINTVFLAMEHHKMEASFEKMLNIGNLVFTSIFIAEMCLKIIALDPYHYFRRGWNIFDSIVALLSFADVMNCVLQKRSWPFLRSFRVLRVFKLAKSWPTLNTLIKIIGNSVGALGSLTVVLVIVIFIFSVVGMQLFGRSFNSQKSPKLCNPTGPTVSCLRHWHMGDFWHSFLVVFRILCGEWIENMWECMQEANASSSLCVIVFILITVIGKLVVLNLFIALLLNSFSNEERNGNLEGEARKTKVQLALDRFRRAFCFVRHTLEHFCHKWCRKQNLPQQKEVAGGCAAQSKDIIPLVMEMKRGSETQEELGILTSVPKTLGVRHDWTWLAPLAEEEDDVEFSGEDNAQRITQPEPEQQAYELHQENKKPTSQRVQSVEIDMFSEDEPHLTIQDPRKKSDVTSILSECSTIDLQDGFGWLPEMVPKKQPERCLPKGFGCCFPCCSVDKRKPPWVIWWNLRKTCYQIVKHSWFESFIIFVILLSSGALIFEDVHLENQPKIQELLNCTDIIFTHIFILEMVLKWVAFGFGKYFTSAWCCLDFIIVIVSVTTLINLMELKSFRTLRALRPLRALSQFEGMKVVVNALIGAIPAILNVLLVCLIFWLVFCILGVYFFSGKFGKCINGTDSVINYTIITNKSQCESGNFSWINQKVNFDNVGNAYLALLQVATFKGWMDIIYAAVDSTEKEQQPEFESNSLGYIYFVVFIIFGSFFTLNLFIGVIIDNFNQQQKKLGGQDIFMTEEQKKYYNAMKKLGSKKPQKPIPRPLNKCQGLVFDIVTSQIFDIIIISLIILNMISMMAESYNQPKAMKSILDHLNWVFVVIFTLECLIKIFALRQYYFTNGWNLFDCVVVLLSIVSTMISTLENQEHIPFPPTLFRIVRLARIGRILRLVRAARGIRTLLFALMMSLPSLFNIGLLLFLIMFIYAILGMNWFSKVNPESGIDDIFNFKTFASSMLCLFQISTSAGWDSLLSPMLRSKESCNSSSENCHLPGIATSYFVSYIIISFLIVVNMYIAVILENFNTATEESEDPLGEDDFDIFYEVWEKFDPEATQFIKYSALSDFADALPEPLRVAKPNKYQFLVMDLPMVSEDRLHCMDILFAFTARVLGGSDGLDSMKAMMEEKFMEANPLKKLYEPIVTTTKRKEEERGAAIIQKAFRKYMMKVTKGDQGDQNDLENGPHSPLQTLCNGDLSSFGVAKGKVHCD

SEQ ID NO: 30 - protein, 1791 aa, Pan troglodytes; identical to SEQ ID NO: 29

SEQ ID NO: 31 - protein, 1988 aa, Macaca mulatta
MAMLPPPGPQSFVHFTKQSLALIEQRIAERKSKEPKEEKKDDDEEAPKPSSDLEAGKQLPFIYGDIPPGMVSEPLEDLDPYYADKKTFIVLNKGKTIFRFNATPALYMLSPFSPLRRISIKILVHSLFSMLIMCTILTNCIFMTMSNPPDWTKNVEYTFTGIYTFESLVKILARGFCVGEFTFLRDPWNWLDFIVIVFAYLTEFVNLGNVSALRTFRVLRALKTISVIPGLKTIVGALIQSVKKLSDVMILTVFCLSVFALIGLQLFMGNLKHKCVQNSLVNNETLESIMNTLESEEDFRKYFYYLEGSKDALLCGFSTDSGQCPEGYTCMKIGRNPDYGYTSFDTFSWAFLALFRLMTQDYWENLYQQTLRAAGKTYMIFFVVVIFLGSFYLINLILAVVAMAYEEQNQANIEEAKQKELEFQQMLDRLKKEQEEAEAIAAAAAEYTSIRRSRIMGLSESSSETSKLSSKSAKERRNRRKKKNQKKLSSGEEKGDAEKLSKSDSEENIRRKSFHLGVEGHRRAHEKRLSTPSQSPLSIRGSLFSARRSSRTSLFSFKGRGRDIGSETEFADDEHSIFGDNESRRGSLFVPHRPQERRSSNISQASRSPPILPVNGKMHSAVDCNGVVSLVDGRSALMLPNGQLLPEVIIDKATSDDSGTTNQIHKKRRCSSYLLSEDMLNDPNLRQRAMSRASILTNTVEELEESRQKCPPWWYRFAHKFLIWNCSPYWIKFKKCIYFIVMDPFVDLAITICIVLNTLFMAMEHHPMTEEFKNVLAIGNLVFTGIFAAEMVLKLIAMDPYEYFQVGWNIFDSLIVTLSLVELFLADVEGLSVLRSFRLLRVFKLAKSWPTLNMLIKIIGNSVGALGNLTLVLAIIVFIFAVVGMQLFGKSYKECVCKINDDCTLPRWHMNDFFHSFLIVFRVLCGEWIETMWDCMEVAGQAMCLIVYMMVMVIGNLVVLNLFLALLLSSFSSDNLTAIEEDPDANNLQIAVTRIKKGINYVKQTLREFILKTFSKKPKISREIRQTEDLNTKKENYISNYTLAEMSKGHNFLKEKDKISGFGSCVDKYLMEDSDGQSFIHNPSLTVTVPIAPGESDLENMNTEELSSDSDSEYSKVRLNQSSSSECSTVDNPLPGEGEEAEAEPMNSDEPEACFTDGCVRRFSCCQVNIESGKGKIWWNIRKTCYKIVEHSWFESFIVLMILLSSGALAFEDIYIERKKTIKIILEYADKIFTYIFILEMLLKWIAYGYKTYFTNAWCWLDFLIVDVSLVTLVANTLGYSDLGPIKSLRTLRALRPLRALSRFEGMRVVVNALIGAIPSIMNVLLVCLIFWLIFSIMGVNLFAGKFYECINTTDGSRFPASQVPNRSECFALMNVSQNVRWKNLKVNFDNVGLGYLSLLQVATFKGWTIIMYAAVDSVNVDKQPKYEYSLYMYIYFVIFIIFGSFFTLNLFIGVIIDNFNQQKKKLGGQDIFMTEEQKKYYNAMKKLGSKKPQKPIPRPGNKIQGCIFDLVTNQAFDISIMVLICLNMVTMMVEKEGQSPYMTDVLYWINVVFIILFTGECVLKLISLRYYYFTIGWNIFDFVVVIISIVGMFLADLIETYFVSPTLFRVIRLARIGRILRLVKGAKGIRTLLFALMMSLPALFNIGLLLFLVMFIYAIFGMSNFAYVKKEDGINDMFNFETFGNSMICLFQITTSAGWDGLLAPILNSKPPDCDPKKVHPGSSVEGDCGNPSVGIFYFVSYIIISFLVVVNMYIAVILENFSVATEESTEPLSEDDFEMFYEVWEKFDPDATQFIEYNKLSDFAAALDPPLLIAKPNKVQLIAMDLPMVSGDRIHCLDILFAFTKRVLGESGEMDSLRSQMEERFMSANPSKVSYEPITTTLKRKQEDVSATVIQRAYRRYRLRQNVKNISSIYIKDGDRDDDLLNKKDMAFDNVNENSSPEKTDATSSTTSPPSYDSVTKPDKEKYEQDRTEKEDKGKDSKESKK

SEQ ID NO: 32 - protein, 1988 aa, Artificial Sequence
  Galeopterus variegatus
MAMLPPPRPQSFVRFTKQSLALIEQRIAEGKTKEPKEEKKDSDEEGPKPSSDLEAGKQLPFIYGDIPPDMVSEPLEDLDPFYADKKTFIVLNKGKAIFRFNATPALYMLSPFSPLRRISIKILVHSFFSMLIMCTILTNCIFMTLSTPPDWTKNVEYTFTGIYTFESLIKILARGFCVGEFTFLRDPWNWLDFVVIVFAYLTEFVNLGNVSALRTFRVLRALKTISVIPGLKTIVGALIQSVKKLSDVMILTVFCLSVFALIGLQLFMGNLKHKCFRNSLENNETLQSIIETLETEEDYRRYFYYLEGSKDALLCGFSTDSGQCPEGYTCVKAGRNPDYGYTSFDTFSWAFLALFRLMTQDYWENLYQQTLRAAGKTYMIFFVVVIFLGSFYLINLILAVVAMAYEEQNQANIEEARQKELEFQQMLEQLKKEQEEAEAIAVAVAEHTSIGRSRIMGVSESSSETSKLSSKSAKERRNRRKKKNQKKLSSGEEKGDDEKLSKSESEESIRRKSFYLGVEGHGRAREKRLSTPNQSPLSIRGSLFSARRSSRTSLFSFKGRGKDIGSETEFADDEHSIFGDNESRRGSLFVPHRPRERRSSNISQASRSPPMLPVNGKMHSAVDCNGVVSLVDGPSALMLPNGQLLPEVIIDKATSDDSGTTNQIRKKRRSSSYLLSEDMLNDPNLRQRAMSRASILTNTMEELEESRQKCPPWWYKFAHTFLIWNCSPFWIKFKKLIYFIVMDPFVDLAITICIVLNTLFMAMEHHPMTNEFKNALAVGNLVFTGIFAAEMVLKLIAMDPYEYFQVGWNIFDSLIVTLSLVELCLSEVEGLSVLRSFRLLRVFKLAKSWPTLNMLIKIIGNSVGALGNLTLVLAIIVFIFAVVGMQLFGKSYKECVCKISDDCTLPRWHMTDFFHSFLIVFRVLCGEWIETMWDCMEVAGQAMCLIVYMMVMVIGNLVVLNLFLALLLSSFSSDNLTAIEEDTDANNLQIAVARINKGVNYMKQSLRECILKAFSKKPKISGEIKRAENINSKKENYVSNRTLAEMSKDHSFYKEKDKIGGLGSSMDKYLMDESDYQSFIHNPSLTVTVPIAPGESDLENMNTEELSSDSDSECTKEVLNRSSSSECSTVDNPVPGEGEEAEAEPVNSDEPEACFTDGCVRRFPCCQVNIESGKGKIWWNIRKTCYKIVEHSWFESFIVLMILLSSGALAFEDIYIERKKTIKIILEYADKIFTYIFILEMLLKWVAYGYKTYFTNAWCWLDFLIVDVSLVTLVANTLGYSDLGPIKSLRTLRALRPLRALSRFEGMRVVVNALIGAIPSIMNVLLVCLIFWLIFSIMGVNLFAGKFYECINTTDGSRFPTTQVSNRSDCFALMNVSQNVRWKNLKVNFDNVGLGYLSLLQVATFKGWMDIMYAAVDSVNVDKQPKYEYSIYMYIYFVIFIIFGSFFTLNLFIGVIIDNFNQQKKKLGGQDIFMTEEQKKYYNAMKKLGSKKPQKPIPRPGNKFQGCIFDLVTNQVFDITIMVLICLNMVTMMVEKEEQSQYMVDVLYWINVAFIILFTGECVLKLISLRHYYFTVGWNIFDFVVVILSIVGMFLADLIEKYFVSPTLFRVIRLARIGRILRLIKGAKGIRTLLFALMMSLPALFNIGLLLFLVMFIYAIFGMSNFAYVKKEAGINDMFNFETFGNSMICLFQITTSAGWDGLLAPILNSAPPDCDPKKVHPGSSVEGDCGNPSVGIFYFVSYIIISFLVVVNMYIAVILENFSVATEESTEPLGEDDFEMFYEVWEKFDPDATQFIEYSKLSDFAAALDPPLLIAKPNKVQLIAMDLPMVSGDRIHCLDILFAFTKRVLGESGEMDSLRSQMEERFMSANPSKVSYEPITTTLKRKQEDVSATVIQRAFRRYRLRQNVKNISSMYIKDGDRDDDLPHKEDVVFGNVNGNSSPEKTDATPSTVSPPSYDSVTMPDKEKYEKDKTEKEDKGKDGKESKK

SEQ ID NO: 33 - protein, 1987 aa, Bos taurus
MAMLPPPGPQSFVFFTKQSLALIEQRIAEGKAKEPKEEKKDDDDEGPKPSSDLEAGKQLPFIYGDIPPGMVSEPLEDLDPYYADKKTFIVLNKGKAIFRFNATPALYMLSPFSPLRRISIKILVHAAFSMLIMCTILTNCIFMTMSNPPDWTKNVEYTFTGIYTFESLVKILARGFCVGEFTFLRDPWNWLDFIVIVFAYLTEFVNLGNVSALRTFRVLRALKTISVIPGLKTIVGALIQSVKKLSDVMILTVFCLSVFALIGLQLFMGNLKHKCVQSSLANNETMENILNTLDEEEYAKYFYYLEGSKDALLCGFSSDSGQCPEGYTCKKIGRNPDYGYTSFDTFSWAFLALFRLMTQDYWENLYQQTLRAAGKTYMIFFVVVIFLGSFYLINLILAVVAMAYEEQNQANIEEARQKELEFQQMLDRLKKEQEEAEAIALAAAEYTSIGRSRIMGLSESSSETSKLSSKSAKERRNRRRKKNQKKLSSGEEKGDDEKLSKSESEESIRRKSFHLGVEGHRRAREKRLSTPNQSPLSIRGSLFSARRSSRTSLFSFKGRGRDIGSETEFADDEHSIFGDNESRRGSLFVPHRPRERRSSNISQASRSPPVLPVNGKMHSAVDCNGVVSLVDGPSALMLPNGQLLPEVIIDKATSDDSGTTNQIHKKRRHSSYLLSEDMLNDPNLRQRAMSRASILTNTVEELEESRQKCPPWWYRFAHTFLIWNCSPYWIKFKKFIYFIVMDPFVDLAITICIVLNTLFMAMEHHPMTEEFKNVLVVGNLVFTGIFAAEMVLKLIAMDPYEYFQIGWNIFDSLIVTLSLVELFLSDVEGLSVLRSFRLLRVFKLAKSWPTLNMLIKIIGNSVGALGNLTLVLAIIVFIFAVVGMQLFGKSYKECVCKINEDCTLPRWHMNDFFHSFLIVFRVLCGEWIETMWDCMEVAGQAMCLIVYMMVMVIGNLVVLNLFLALLLSSFSSDNLTAIEEDTDANNLQIAVARIKKGINYVKQTLREFVLKAFSKKPKISKEIRQTEDLNCKKENYISNRTLAEMSKDHKFHKEKDKTSGFGNSMDKYLMEESDGQSFIHNPSLTVTVPIAPGESDLEIMNTEELSSDSDSEYSKGRLNQSSSSECSTVDNPVPGEGEEAEAEPVNSDEPEACFTDGCVQRFPCCQVNIESGKGKIWWNIRKTCFRIVEHSWFESFIVLMILLSSGALAFEDIYIEKKKNIKIILEYADKIFTYIFILEMLLKWVAYGYKTYFTNAWCWLDFLIVDVSLVTLVANTLGYSDLGPIKSLRTLRALRPLRALSRFEGMRVVVNALIGAIPSIMNVLLVCLIFWLIFSIMGVNLFAGKFYECINTTNGLRFPTSEVENRSACLALMNVSQNVRWKNLKVNFDNVGLGYLSLLQVATFKGWMDIMYAAVDSVNVNKQPIYEYSLYMYIYFVIFIIFGSFFTLNLFIGVIIDNFNQQKKKLGGQDIFMTEEQKKYYNAMKKLGSKKPQKPIPRPGNKFQGCIFDLVTNQAFDIAIMVLICLNMVTMMVEKEGQSDYVTEVLNWINVVFIILFSGECVLKLISLRCYYFTVGWNIFDFVVVILSIVGMFLADLIERYFVSPTLFRVIRLARIGRILRLIKGAKGIRTLLFALMMSLPALFNIGLLLFLVMFIYAIFGMSNFAYVKKEAGINDMFNFETFANSMICLFQITTSAGWDGLLAPILNSKPPDCDPKKVHPGSSVEGDCGNPSVGIFYFVSYIIISFLVVVNMYIAVILENFSVATEESTEPLSEDDFEMFYEVWEKFDPDATQFIEYSKLSDFAAALDPPLLIAKPNKVQLIAMDLPMVSGDRIHCLDILFAFTKRVLGEGGEMDSLRSQMEERFMSANPSKVSYEPITTTLKRKQEDVSATVIQRAYRRYRLRQNVKNISSIYIKDGDRDDDLPNKEDMVFDNVNENSSPEKTGATPSTVSPPSYDSVTKPDREKYEKDKTEKEDKGKDGKEGKK

SEQ ID NO: 34 - protein, 1987 aa, Ovis aries
MAMLPPPGPQSFVFFTKQSLALIEQRIAEGKAKEPKEEKKDDDEEGPKPSSDLEAGKQLPFIYGDIPPGMVSEPLEDLDPYYADKKTFIVLNKGKAIFRFNATPALYMLSPFSPLRRISIKILVHAAFSMLIMCTILTNCIFMTMSNPPDWTKNVEYTFTGIYTFESLVKILARGFCVGEFTFLRDPWNWLDFIVIVFAYLTEFVNLGNVSALRTFRVLRALKTISVIPGLKTIVGALIQSVKKLSDVMILTVFCLSVFALIGLQLFMGNLKHKCVQTSLANNETIEDILNALDEEEYAKYFYYLEGSKDALLCGFSTDSGQCPEGYTCKKIGRNPDYGYTSFDTFSWAFLALFRLMTQDYWENLYQQTLRAAGKTYMIFFVVVIFLGSFYLINLILAVVAMAYEEQNQANIEEARQKELEFQQMLDRLKKEQEEAEAIALAAAEYTSIGRSRIMGLSESSSETSKLSSKSAKERRNRRRKKNQKKLSSGEEKGDDEKLSKSESEESIRRKSFHLGVEGHRRAREKRLSTPNQSPLSIRGSLFSARRSSRTSLFSFKGRGRDIGSETEFADDEHSIFGDNESRRGSLFVPHRPRERRSSNISQASRSPPVLPVNGKMHSAVDCNGVVSLVDGPSALMLPNGQLLPEVIIDKATSDDSGTTNQIYKKRRHSSYLLSEDMLNDPNLRQRAMSRASILTNTVEELEESRQKCPPWWYRFAHTFLIWNCSPYWIKFKKFIYFIVMDPFVDLAITICIVLNTLFMAMEHHPMTEEFKNVLVVGNLVFTGIFAAEMVLKLIAMDPYEYFQIGWNIFDSLIVTLSLVELFLSDVEGLSVLRSFRLLRVFKLAKSWPTLNMLIKIIGNSVGALGNLTLVLAIIVFIFAVVGMQLFGKSYKECVCKINEDCKLPRWHMNDFFHSFLIVFRVLCGEWIETMWDCMEVAGQAMCLIVYMMVMVIGNLVVLNLFLALLLSSFSSDNLTAIEEDTDANNLQIAVARIKTGINYVKQTLREFVLKAFSKKPKISKEIRQTEDLNCKKENYISNRTLAEMSKDHNFHKEKDKTSGFGNNMDKYLMEESDGQSFIHNPSLTVTVPIAPGESDLEIMNTEELSSDSDSEYSKGRLNQSSSSECSTVDNPVPGEGEEAEAEPVNSDEPEACFTDGCVQRFPCCQVNIESGKGKIWWNIRKTCFRIVEHSWFESFIVLMILLSSGALAFEDIYIEKKKTIKIILEYADKIFTYIFILEMLLKWVAYGYKTYFTNAWCWLDFLIVDVSLVTLVANTLGYSDLGPIKSLRTLRALRPLRALSRFEGMRVVVNALIGAIPSIMNVLLVCLIFWLIFSIMGVNLFAGKFYECINTTNGLRFPTNEVENRSACLALMNVSQNVRWKNLKVNFDNVGLGYLSLLQVATFKGWMDIMYAAVDSVNVDKQPIYEYSLYMYIYFVIFIIFGSFFTLNLFIGVIIDNFNQQKKKLGGQDIFMTEEQKKYYNAMKKLGSKKPQKPIPRPGNKFQGCIFDLVTNQAFDIAIMVLICLNMVTMMVEKEGQSEYMTEVLYWINVVFIILFSGECVLKLISLRCYYFTVGWNIFDFVVVILSIVGMFLADLIERYFVSPTLFRVIRLARIGRILRLIKGAKGIRTLLFALMMSLPALFNIGLLLFLVMFIYAIFGMSNFAYVKKEAGINDMFNFETFGNSMICLFQITTSAGWDGLLAPILNSAPPDCDPKKVHPGSSVEGDCGNPSVGIFYFVSYIIISFLVVVNMYIAVILENFSVATEESTEPLSEDDFEMFYEVWEKFDPDATQFIEYSKLSDFAAALDPPLLIAKPNKVQLIAMDLPMVSGDRIHCLDILFAFTKRVLGEGGEMDSLRSQMEERFMSANPSKVSYEPITTTLKRKQEDVSATVIQRAYRRYRLRQHVKNISSIYIKDGDRDDDLPNKEHMVFDNVNENSSPEKTDATPSTVSPPSYDSVTKPDREKYEKDKTEKEDKGKDGKEGKK

SEQ ID NO: 35 - protein, 1981 aa, Camelus dromedarius
MAMLPPPGPQSFVYFTKQSLALIEQRIAEGKTKEPKEEKKDDDEEGPKPSSDLEAGKQLPFIYGDIPPGMVSEPLEDLDPYYADKKTFIVLNKGKAIFRFNAAPALYLLSPFNPLRRISIKILVHSLFSMLIMCTILTNCIFMTLSSPPDWTKNVEYTFTGIYTFESLVKILARGFCVGEFTFLRDPWNWLDFVVIVFAYLTEFVNLGNVSALRTFRVLRALKTISVIPGLKTIVGALIQSVKKLSDVMILTVFCLSVFALIGLQLFMGNLKHKCVWTPFENNETIESMLDSLDEEDRSKYFYYLEGSKDALLCGFSTDSGQCPEGYTCMKIGRNPDYGYTSFDTFSWAFLALFRLMTQDYWENLYQQTLRAAGKTYMIFFVVVIFLGSFYLINLILAVVAMAYEEQNQANIEEARQKEIEFQQMLDHLKKEQEEAEAIAMAAAEYTSIGRSRIMGLSESSSETSRLSSKSAKERRNRRKKRNQKKLSSGEEKGDDEKLSKSESEENIRRKSFRLGVEGPWRAHEKRLSTPNQSPLSIRGSLFSARRSSRTSLFSFKGRGKDIGSETEFADDEHSIFGDSESRRGSLFVPHRPRERRSSSISQASRSPPVLPVNGKMHSAVDCNGVVSLVDGPAALMLPNGQLLPEVIIDKATSDDSGTTNQIHKKRRPSSYLLSEDMLNDPNLRKRAMSRASILTNTVEELEESRQKCPPWWYRFAHTFLIWNCSPYWIKFKKVIYFIVMDPFVDLAITICIVLNTLFMAMEHHPMTDEFKNVLTVGNLVFTGIFAAEMVLKLIAMDPYEYFQVGWNIFDSLIVTLSLVELFLADVEGLSVLRSFRLLRVFKLAKSWPTLNMLIKIIGNSVGALGNLTLVLAIIVFIFAVVGMQLFGKSYRECVCKISEECTLPRWHMNDSFLIVFRVLCGEWIETMWDCMEVAGQAMCLIVYMMVMVIGNLVVLNLFLALLLSSFSSDNLTAIEEDTDANNLQIAVARIKKGINYVKQTLHEFILKAFSKKPKVSKEIRRADLNCKKENFISNRTLAEMSKDHHFHKEKDKTSGFGNSVDKYLMEESDGQSFIHNPSLTVTVPIAPGESDLEIMNTEELSSDSDSEYSKGRLNRSSSSECSTVDNALPEKEAEAEPVNPDEPAACFTDGCVRRFPCCQVNIESGKGRIWWNIRKTCYRIVEHSWFESFIVLMILLSSGALAFEDIYIEKKRTIKTILEYADKIFTYIFILEMLLKWVAYGYKIYFTNAWCWLDFLIVDVSLVTLVAAAFGYSDLGPIRSLRTLRALRPLRALSRFEGMRVVVNALIGAIPSIMNVLLVCLIFWLIFSIMGVNLFAGKFYECINTTDGSRFHTNRVENRSECFALMNVSQNVRWKNLKVNFDNVGLGYLSLLQVATFKGWMDIMYAAVDSVNVDKQPIYEYNLYMYIYFVIFIIFGSFFTLNLFIGVIIDNFNQQKKKLGGQDIFMTEEQKKYYNAMKKLGSKKPQKPIPRPGNKFQGCIFDLVTNQAFDITIMVLICLNMVTMMVEKEGQSEYMTEVLYWINVVFIILFTGEFVLKLISLRCYYFTVGWNIFDFVVVILSIVGMFLADLIEKYFVSPTLFRVIRLARIGRILRLIKGAKGIRTLLFALMMSLPALFNIGLLLFLVMFIYAIFGMSNFAYVKKEAGINDMFNFETFGNSMICLFQITTSAGWDGLLAPILNSGPPDCDPKKVHPGSSVEGDCGNPSVGIFYFVSYIIISFLVVVNMYIAVILENFSVATEESTEPLSEDDFEMFYEVWEKFDPDATQFIEYSKLSDFAAALDPPLLIAKPNKVQLIAMDLPMVSGDRIHCLDILFAFTKRVLGESGEMDSLRLQMEERFMSANPSKVSYEPITTTLKRKQEDVSATVIQRAYRRYRLRQNVKNISSIYIKDGGKDDDLPKKEDTVFDNVNGNSSPEKTDATSSTTSPPSYDSVTKPDKEKYEKDKTEKEDKGKDGKESKK

SEQ ID NO: 36 - protein, 1987 aa, Orcinus orca
MAMLPPPGPQSFVYFTKQSLALIEQRIAEGKTKEPKEEKKDDDEEGPKPSSDLEAGKQLPFIYGDIPQGMVSEPLEDLDPYYADKKTFIVLNKGKAIFRFNATPALYILSPFSPLRRISIKILVHSAFSMLIMCTILTNCIFMTMSNPPDWTKNVEYTFTGIYTFESLVKILARGFCVGEFTFLRDPWNWLDFIVIVFAYLTEFVNLGNVSALRTFRVLRALKTISVIPGLKTIVGALIQSVKKLSDVMILTVFCLSVFALIGLQLFMGNLKQKCVRTLLENNETIESILNTLDEEDYGKYFYYLEGSKDALLCGFSTDSGQCPEGYTCVKVGKNPDYGYTSFDTFSWAFLALFRLMTQDYWENLYQQTLRAAGKTYMIFFVVVIFLGSFYLINLILAVVAMAYEEQNQANIEEARQKELEFQQMLDRLKKEQEEAEAIAMAAAEYTSIERSRIMGLSESSSETSKMSSKSAKERRNRRKKNNQKKLSIGEEKGDDEKLSKSESEESIRRKSFHLGVEGHRRAREKRFSTPNQSPLSIHGSLFSARRSSRTSLFSFKGRGKDIGSETEFADDEHSIFGDNESRRGSLFVPHRPRERRSSNISQASRSPPGLPVNRKMHSAVDCNGVVSLVDGPSALMLPNGQLLPEVIIDKATSDDSGTNNQIHKKRRSSSYLLSEDMLNDPNLRQRAMSRASILTNTVEELEESRQKCPPWWYRFAHTFLIWNCSPYWIKFKRLIYFIVMDPFVDLAITICIVLNTLFMAMEHHPMTDEFKNVLTVGNLVFTGIFAAEMVLKLIAMDPYEYFQVGWNIFDSLIVTLSLVELFLADVEGLSVLRSFRLLRVFKLAKSWPTLNMLIKIIGNSVGALGNLTLVLAIIVFIFAVVGMQLFGKSYKECVCKINEDCTLPRWHMNDFFHSFLIVFRVLCGEWIETMWDCMEVAGQAMCLIVYMMVMVIGNLVVLNLFLALLLSSFSSDNLTAIEEDTDANNLQTAVARIKKGINYVKQTLREFFLKGFSTKPKISKEIRRTEDLNYKKENYISNHTLAEMSKDHNFHKEKDKTSGFGNSMDKYLVEESDGQSFIHNASLTVTVPIAPGESDLEIMNTEELSSDSDSEYSKGRLNGSSSSECSTVDNPVPGEGEEAEAEPVNSDEPEACFTDGCVQRLPCCQVNTESGKGKIWWNIRKTCYRIVEHSWFESFIVLMILLSSGALAFEDIYIEKKKTIKIILEYADKIFTYIFILEMLLKWIAYGYKTYFTNAWCWLDFLIVDVSLVTLVANTLGYSDLGPIKSLRTLRALRPLRALSRFEGMRVVVNALIGAIPSIMNVLLVCLIFWLIFSIMGVNLFAGKFYQCVNTTDGSPFPTSEVENRSECFALMNVSQNVQWKNLKVNFDNVGLGYLSLLQVATFKGWMVIMYAAVDSVNVDRQPIYEYSLYMYIYFVIFIIFGSFFTLNLFIGVIIDNFNQQKKKLGGQDIFMTEEQKKYYNAMKKLGSKKPQKPIPRPGNKFQGCIFDLVTNQAFDIAIMVLICLNMVTMMVEKEGQSAYMTEVLYWINVVFVILFTGECVLKLISLRCYYFTVGWNIFDFVVVILSIVGMFLADLIERYFVSPTLFRVIRLARIGRILRLIKGAKGIRTLLFALMMSLPALFNIGLLLFLVMFIYAIFGMSNFAYVKKEAGINDMFNFETFGNSMICLFQITTSAGWDGLLAPILNSAPPDCDPRKVHPGSSVEGDCGNPSVGIFYFVSYIIISFLVVVNMYIAVILENFSVATEESTEPLSEDDFEMFYEVWEKFDPDATQFIEYSKLSDFAAALDPPLLVAKPNKVQLIAMDLPMVSGDRIHCLDILFAFTKRVLGESGEMDSLRSQMEERFMSANPSKVSYEPITTTLKRKQEDVSATVIQRAYRRYRLRQNVKNISSIYIKDGDRDDDLPNKEDMVFDNVNENSSPEKTDGTPSTISPPSYDSVTKPDKEKYEKDKTEKEDKGKDGKEGKK

SEQ ID NO: 37 - protein, 1975 aa, Equus caballus
MAMLPPPGPQSFVYFTKQSLARIEQRIAEGKTKEPKEEKKDDDEEGPKPSSDLEAGKQLPFIYRDIPPGMVSEPLEDLDPYYADKKTFIVLNKGKAIFRFNATPALYILSPFSPLRRISIKILVHSLFSMLIMCTILTNCIFMTMSNPPDWTKNVEYTFTGIYTFESLVKILARGFCIGEFTFLRDPWNWLDFVVIVFAYLTEFVNLGNVSALRTFRVLRALKTISVIPGLKTIVGALIQSVKKLSDVMILTVFCLSVFALIGLQLFMGNLKHKCLRNPLENNETLESIMDTLEEEDFRKYFYYLEGSKDALLCGFSTDSGQCPEGYICVKAGRNPDYGYTSFDTFSWAFLALFRLMTQDYWENLYQQTLRAAGKTYMIFFVVVIFLGSFYLINLILAVVAMAYEEQNQANIEEARQKELEFQQMLDRLKKEQEEAEAIAMAAAEYTSIGRSRIMGLSESSSETSKLSSKSAKERRNRRRKKNQKKLSSGEEKGDDEKLSKSESEESIRRKSFHLGIEGHRRAHEKRLSTPNQSPLSIRGSLFSARRSSRTSLFSFKGRGKDIGSETEFADDEHSIFGDNESRRGSLFVPHRPRERRSSNISQASRSPPMLPVNGKMHSAVDCNGVVSLVDGPSALMLPNGQLLPEGTTNQIHKKRRSSSYLLSEDMLNDPNLRQRAMSRASILTNTVEELEESRQKCPPWWYRFAHTFLIWNCSPYWIKFKKLIHFIVMDPFVDLAITICIVLNTLFMAMEHHPMTDEFKNVLTVGNLVFTGIFAAEMVLKLIAMDPYEYFQVGWNIFDSLIVTLSLVELFLADVEGLSVLRSFRLLRVFKLAKSWPTLNMLIKIIGNSVGALGNLTLVLAIIVFIFAVVGMQLFGKSYKECVCKINEDCELPRWHMNDFFHSFLIVFRVLCGEWIETMWDCMEVAGQAMCLIVYMMVMVIGNLVVLNLFLALLLSSFSSDNLTAIEEDTDTNNLQIAVTRIKKGINYVKQTLREFILKAFSKKPKISKEIRRADLNSKKENYISNRTLAEMSKDHNFHKDKDKTGGFRSSVDKYLMEESDCQSFIHNPSLTVTVPIAPGESDLENMNTEELSSDSESEYSKGRLNQSSSSECSTVDNPLPGEGEEAEAEPVNSDEPEACFTDGCVQRFPCCQVNIESEKGKIWWNIRKTCYRIVEHSWFESFIVLMILLSSGALAFEDIYIEKKKNIKIILEYADKIFTYVFILEMLLKWVAYGYKTYFTNAWCWLDFLIVDVSLVTLVANTLGYSDLGPIKSLRTLRALRPLRALSRFEGMRVVVNALIGAIPSIMNVLLVCLIFWLIFSIMGVNLFAGKFYQCVNTTDGSRFLTNEVQNRSDCFALMNVSQNVRWKNLKVNFDNVGLGYLSLLQVATFKGWMDIMYAAVDSVNVDKQPIYEYSLYMYIYFVIFIIFGSFFTLNLFIGVIIDNFNQQKKKLGGQDIFMTEEQKKYYNAMKKLGSKKPQKPIPRPGNKFQGCIFDLVTNQAFDISIMVLICLNMVTMMVEKEGQSDYMTDVLYWINVVFIILFTGECVLKLVSLRHYYFTVGWNIFDFVVVILSIVGMFLADLIEKYFVSPTLFRVIRLARIGRILRLIKGAKGIRTLLFALMMSLPALFNIGLLLFLVMFIYAIFGMSNFAYVKKEAGINDMFNFETFGNSMICLFQITTSAGWDGLLAPILNSAPPDCDPRKVHPGSSVEGDCGNPSVGIFYFVSYIIISFLVVVNMYIAVILENFSVATEESTEPLSEDDFEMFYEVWEKFDPDATQFIEFSKLSDFAAALDPPLLIAKPNKVQLIAMDLPMVSGDRIHCLDILFAFTKRVLGESGEMDSLRSQMEERFMSANPSKVSYEPITTTLKRKQEDVSATVIQRAYRRYRLRQNVKNISSIYIKDGERDDDLPSKKDMVFDNVNENSSTEKTDATPSTVSPPSYDSVTKPDKEKYEKDKTEKEDKEKDGKESKK

SEQ ID NO: 38 - protein, 1986 aa, Canis lupus
MATLPPPGPQSFVYFTKQSLALIEQRIAEGKTKEPKEEKKDDDEEGPRPSSDLEAGKQLPFIYGDIPPGMVSEPLEDLDPYYADKKTFIVLNKGKAIFRFNATPALYMLSPFSPLRRISIKILVHSLFSMLIMCTILTNCIFMTMSNPPDWTKNVEYTFTGIYTFESLVKILARGFCVGEFTFLRDPWNWLDFVVIVFAYLTEFVNLGNVSALRTFRVLRALKTISVIPGLKTIVGALIQSVKKLSDVMILTVFCLSVFALIGLQLFMGNLKHKCLRDPLDDNETLTSLLDTLEEEDYKKYFYYLEGSKDALLCGLSTDSGQCPEGYKCVKAGRNPDYGYTSFDTFSWAFLALFRLMTQDYWENLYQQTLRAAGKTYMIFFVVVIFLGSFYLINLILAVVAMAYEEQNQANIEEARQKELEFQQMLDRLKKEQEEAEAIAIAAAEYTSIGRSRMMGFSESSSETSKLSSKSAKERRNRRKKRNQKKLSSGEEKGDNEKLSKSESEESIRRQSFHLGVEGHRRAREKRLSTPNQSPLSIRGSLFSGRRSSRTSLFSFKGRGKDIGSETEFADDEHSIFGDSESRRGSLFVPHRPRERRSSNISQASRSPPVLPVNGKMHSAVDCNGVVSLVDGPSALMLPNGQLLPEVIIDKATSDDSGTTNQIHKKRRSSSYLLSEDMLNDPNLRQRAMSRVSILTNTVEELEESRQKCPPWWYRFAHTFLIWNCSPYWIKFKKLVYFIVMDPFVDLAITICIVLNTLFMAMEHHPMTDEFKNVLTVGNLVFTGIFAAEMVLKLIAMDPYEYFQVGWNIFDSLIVTLSLVELFLADVEGLSVLRSFRLLRVFKLAKSWPTLNMLIKIIGNSVGALGNLTLVLAIIVFIFAVVGMQLFGKSYKECVCKINEDCTLPRWHMNDFFHSFLIVFRVLCGEWIETMWDCMEVAGQAMCLIVYMMVMVIGNLVVLNLFLALLLSSFSSDNLTAIEEDTDANNLQIAVARIKKGVNYVKQTLREFILKAFSKKPKISKDTRRAEDQNSKKENCISNRTLAEMNKDHNFHKEKEKISGFGSSMDKYLMEESDCQSFIHNPSLTVTVPIAPGESDLENMNTEELSSDSDSEYSKGRLNRSSSSECSTVDNPLPGEGEEAEAEPVNSDEPEACFTDGCVRRFPCCQVDIESGKGKIWWNIRKTCYRIVEHSWFESFIVLMILLSSGALAFEDIYIEKKKTIKIILEYADKIFTYIFILEMLLKWVAYGYKTYFTNAWCWLDFLIVDVSLVTLVANTLGYSDLGPIKSLRTLRALRPLRALSRFEGMRVVVNALIGAIPSIMNVLLVCLIFWLIFSIMGVNLFAGKFYECVNTTDGSRFPTNLVQNHSDCFALMNVSQNVRWKNLKVNFDNVGLGYLSLLQVATFKGWMDIMYAAVDSVNVDKQPIYEYNLYMYIYFVIFIIFGSFFTLNLFIGVIIDNFNQQKKKLGGQDIFMTEEQKKYYNAMKKLGSKKPQKPIPRPGNKFQGCIFDLVTNQVFDITIMVLICLNMVTMMVEKEGQSKYMTDVLYWINVVFIILFTGECVLKLISLRHYYFTVGWNIFDFVVVILSIVGMFLAELIEKYFVSPTLFRVIRLARIGRILRLIKGAKGIRTLLFALMMSLPALFNIGLLLFLVMFIYAIFGMSNFAYVKKEAGINDMFNFETFGNSMICLFQITTSAGWDGLLAPILNSAPPDCDPKKVHPGSSVEGDCGNPSVGIFYFVSYIIISFLVVVNMYIAVILENFSVATEESTEPLSEDDFEMFYEVWEKFDPDATQFIEYSKLSDFAAALDPPLLIAKPNKVQLIAMDLPMVSGDRIHCLDILFAFTKRVLGESGEMDSLRSQMEERFMSANPSKVSYEPITTTLKRKQEDVSATVIQRAYRRYRLRQNVKNISSIYIKDGDRDDDLPNKEDMVFDNIENSSPEKTDATPSTVSPPSYDSVTKPDKEKYEKDKTEKEDKGKDGKESKK

SEQ ID NO: 39 - protein, 1984 aa, Rattus norvegicus
MAMLPPPGPQSFVHFTKQSLALIEQRISEEKAKEHKDEKKDDEEEGPKPSSDLEAGKQLPFIYGDIPPGMVSEPLEDLDPYYADKKTFIVLNKGKAIFRFNATPALYMLSPFSPLRRISIKILVHSLFSMLIMCTILTNCIFMTLSNPPEWTKNVEYTFTGIYTFESLIKILARGFCVGEFTFLRDPWNWLDFVVIVFAYLTEFVNLGNVSALRTFRVLRALKTISVIPGLKTIVGALIQSVKKLSDVMILTVFCLSVFALIGLQLFMGNLKHKCFRKELEENETLESIMNTAESEEELKKYFYYLEGSKDALLCGFSTDSGQCPEGYICVKAGRNPDYGYTSFDTFSWAFLALFRLMTQDYWENLYQQTLRAAGKTYMIFFVVVIFLGSFYLINLILAVVAMAYEEQNQANIEEAKQKELEFQQMLDRLKKEQEEAEAIAAAAAEFTSIGRSRIMGLSESSSETSRLSSKSAKERRNRRKKKKQKMSSGEEKGDDEKLSKSGSEESIRKKSFHLGVEGHHRTREKRLSTPNQSPLSIRGSLFSARRSSRTSLFSFKGRGRDLGSETEFADDEHSIFGDNESRRGSLFVPHRPRERRSSNISQASRSPPVLPVNGKMHSAVDCNGVVSLVDGPSALMLPNGQLLPEVIIDKATSDDSGTTNQMRKKRLSSSYFLSEDMLNDPHLRQRAMSRASILTNTVEELEESRQKCPPWWYRFAHTFLIWNCSPYWIKFKKLIYFIVMDPFVDLAITICIVLNTLFMAMEHHPMTEEFKNVLAVGNLIFTGIFAAEMVLKLIAMDPYEYFQVGWNIFDSLIVTLSLIELFLADVEGLSVLRSFRLLRVFKLAKSWPTLNMLIKIIGNSVGALGNLTLVLAIIVFIFAVVGMQLFGKSYKECVCKINVDCKLPRWHMNDFFHSFLIVFRVLCGEWIETMWDCMEVAGQTMCLIVYMMVMVIGNLVVLNLFLALLLSSFSSDNLTAIEEDTDANNLQIAVARIKRGINYVKQTLREFILKSFSKKPKGSKDTKRTADPNNKKENYISNRTLAEMSKDHNFLKEKDRISGYGSSLDKSFMDENDYQSFIHNPSLTVTVPIAPGESDLEIMNTEELSSDSDSDYSKEKRNRSSSSECSTVDNPLPGEEEAEAEPVNADEPEACFTDGCVRRFPCCQVNVDSGKGKVWWTIRKTCYRIVEHSWFESFIVLMILLSSGALAFEDIYIEKKKTIKIILEYADKIFTYIFILEMLLKWVAYGYKTYFTNAWCWLDFLIVDVSLVTLVANTLGYSDLGPIKSLRTLRALRPLRALSRFEGMRVVVNALIGAIPSIMNVLLVCLIFWLIFSIMGVNLFAGKFYECVNTTDGSRFPTSQVANRSECFALMNVSGNVRWKNLKVNFDNVGLGYLSLLQVATFKGWMDIMYAAVDSVNVNEQPKYEYSLYMYIYFVIFIIFGSFFTLNLFIGVIIDNFNQQKKKLGGQDIFMTEEQKKYYNAMKKLGSKKPQKPIPRPGNKFQGCIFDLVTNQAFDITIMVLICLNMVTMMVEKEGQTEYMDYVLHWINMVFIILFTGECVLKLISLRHYYFTVGWNIFDFVVVILSIVGMFLAEMIEKYFVSPTLFRVIRLARIGRILRLIKGAKGIRTLLFALMMSLPALFNIGLLLFLVMFIYAIFGMSNFAYVKKEAGINDMFNFETFGNSMICLFQITTSAGWDGLLAPILNSAPPDCDPKKVHPGSSVEGDCGNPSVGIFYFVSYIIISFLVVVNMYIAVILENFSVATEESTEPLSEDDFEMFYEVWEKFDPDATQFIEFCKLSDFAAALDPPLLIAKPNKVQLIAMDLPMVSGDRIHCLDILFAFTKRVLGEGGEMDSLRSQMEERFMSANPSKVSYEPITTTLKRKQEEVSATIIQRAYRRYRLRQHVKNISSIYIKDGDRDDDLPNKEDTVFDNVNENSSPEKTDVTASTISPPSYDSVTKPDQEKYETDKTEKEDKEKDESRK

SEQ ID NO: 40 - protein, 1984 aa, Oryctolagus cuniculus
MAMLPPPGPQSFVRFTKQSLALIEQRIAEGKTKEPKEEKKDDHDEGPKPSSDLEAGKQLPFIYGDIPAGMVSEPLEDLDPYYADKKTFIVLNKGKAIFRFNATPALYILSPFSPLRRISIKILVHSLFSMLIMCTILTNCIFMTMNNPAEWTKNVEYTFTGIYTFESLVKIFARGFCVGEFTFLRDPWNWLDFIVIVFAYLTEFVNLGNVSALRTFRVLRALKTISVIPGLKTIVGALIQSVKKLSDVIILTVFCLSVFALIGLQLFMGHLKHKCLRKIENETLESIMSSIESEEDYKKYFYYLEGSKDALLCGFSTDSGQCPEGYYCVKAGRNPDYGYTSFDTFSWAFLALFRLMTQDYWENLYQQTLRAAGKTYMIFFVVVIFLGSFYLINLILAVVAMAYEEQNQANIEEAKQKELEFQQMLDRLKKEQEEAEAIAAAAAEYTSIGRSRIMGLSESSSETSKLSSKSAKERRNRRKKKNQKKLSSGEEKGDDEKLSKSESEESISRKQFHLGVEGHRLAREKRLSAPNQSPLSIRGSLFSARRSSRTSLFSFKGRGKDIGSETEFADDEHSIFGDNESRRGSLFVPQRPQERRSSNLSQASRSPPMLQMNGKMHSAVDCNGVVSLVDGPSALMLPNGQLLPEVIIDKATSDDSGTTQIRKKRRSSSYLLSEDMLNDPHLRQRAMSRASILTNTVEELEESRQKCPSWWYRFAHTFLIWNCSPFWIKFKKFIYIIVMDPFVDLAITICIVLNTLFMAMEHHPMTEEFKNVLVVGNLVFTGIFAAEMVLKLIAMDPYEYFQVGWNVFDSLIVTLSLVELFLADVEGLSVLRSFRLLRVFKLAKSWPTLNMLIKIIGNSVGPLGNLTLVLAIIVFIFAVVGMQLFGKSYKECVCKINDDCSLPRWHMNDFFHSFLIVFRVLCGEWIETMWDCMEVAGQAMCLIVYMMVMVIGNLVVLNLFLALLLSSFSSDNLSAIEEDTDANNLQIAVTRIKKGINYVKQTLRELILKAFSKKPKISKEIRQAEDLNSKKENYISNRTLAEMSKDYNFHKEKDKISGFGSSMDKYLMEESDHQSFIHNPSLTVTVPIAPGESDLENMNTEELSSDSESEYSKERLNRSSSSECSTVDNALPGEGEEAEAEPVNSDEPEACFTDGCVRRFPCCQVSIESGKGKIWWNIRKTCYRIVEHSWFESFIVLMILLSSGALAFEDIYIEKKKTIKIILEYADKIFTYIFILEMLLKWVAYGYKTYFTNAWCWLDFLIVDVSLVTLVANTLGYSDLGPIKSLRTLRALRPLRALSRFEGMRVVVNALIGAIPSIMNVLLVCLIFWLIFSIMGVNLFAGKFYQCVNTTDDSRFPTKQVSNRSECFALMNGSQNVRWKNLKVNFDNVGLRYLSLLQVATFKGWMDIMYAAVDSVNVDQQPSYEHNLYMYIYFVIFIIFGSFFTLNLFIGVIIDNFNQQKKKLGGQDIFMTEEQKKYYNAMKKLGSKKPQKPIPRPGNKFQGCIFDLVTNQAFDITIMILICLNMVTMMVEKEGQSDYMTDVLYWINVVFIILFTGECVLKLISLRHYYFTIGWNIFDFVVVILSIVGMFLAELIETYFVSPTLFRVIRLARIGRILRLIKGAKGIRTLLFALMMSLPALFNIGLLLFLVMFIYAIFGMSNFAYVKKEAGINDMFNFETFGNSMICLFQITTSAGWDGLLAPILNSAPPDCDPKKVHPGSSTEGDCGSPSVGIFYFVSYIIISFLVVVNMYIAVILENFSVATEESTEPLSEDDFEMFYEVWEKFDPDATQFIEYSKLSDFAAALDPPLLIAKPNKVQLIAMDLPMVSGDRIHCLDILFAFTKRVLGESGEMDSLRSQMEERFMSANPSKVSYEPITTTLKRKQEDVSATVIQRAYRRYRLRQNVKNISSIYIKEGDKDDDLPNKGDIVFDNVNSSSPEKTDATASTISPPSYDSVTKPDKEKYEKDKTEKEDKGKDGKETKK

SEQ ID NO: 41 - protein, 1984 aa, Gallus gallus; identical to SEQ ID NO: 40

SEQ ID NO: 42 - protein, 1730 aa, Ophiophagus hannah
LKTIVGALIQSVKKLSDVMILTLFCLSVFALIGLQLFMGHLRHKCLLWPLSNTSYKDPRFMEYYNGTELMWSKYIENKEHFYFLEGAKDALLCGNSTDAGQCPEGYKCIPAGRNPDYGYTSFDSFSWAFLSLFRLMTQDYWENLYQQTLRAAGKGYMFFFVVVIFLGSFYLVNLILAVVAMAYDEQNQATIEEALRKETEYQQMLEHLKRQQEEAQALAAAVACKDFRDDGALGRLSETSSELSSSKSAKERRNRRKKRRQRELSVGEPGGNSKMFPKSESDSSIRRKGFRFSLEGNRLTYENRVISPYQSMLFPTRRNSRASFSSFKGPTAEGSSDADSEHSTFEENGSRNGSYFVVRRHSDRRSSNISQTMFPMNGKMQSSVDCNGVVSLVGGPPVLLSPTGQLLPEVIIDKATTNDNGTASEMEGKKRRSSSFQISMDLLEDPTIRQRAMSIASIITNTMEELEESRQKCPPCWYKFAHSYLIWNCSDRWLQIKRIIHLIVMDPFVDLGITICIILNTLFMSMEHYPIDDSFSGVLKNGNMVFTGIFTAEMVLKIIAMDPYYYFQEGWNIFDSIIVTLSLMELGLQDVEGLSVLRSFRLLRVFKLAKSWPTLNMLIKIIGNSVGALGNLTLVLAIIVFIFAVVGMQLFGKNYDSCKCKISEDCKLPRWHMNDFFHSFLIVFRVLCGEWIETMWDCMEVAGQALCLTVFMMVMVIGNLVLLNLFLALLLSSFSSDSLAAPEQETEANNLQIAISRIQRGINYIKRKICEFVQIVFLQKCKGTSGLSAADQQNNKKDQCIPNHTVVEINQTFGYQKPKMTTTCMDNSDHMSFINNPNLTVTVPIAVGESDFEHFNTEELTSISELEETKEKTSLCSSTEGSTIIFASVGDKESDTAAKGPPQPQPCFTDGCVQKFRCCQINIESGKGKCWWNLRKTCFKIVEHNWFETFIVFMILLSSGALAFEDIYIEQRKTIKTVLEYADKVFTYIFILEMLLKWVAYGFQVYFTNAWCWLDFMIVDVSLVSLIANALNYSELGPIKSLRTLRALRPLRALSRFEGMRVVVNALVGAIPSIMNVLLVCLIFWLIFSIMGVNLFAGTFFECVNKTDGVRISHLIVPFKNVCETLDYARWRNVKVNFDNVGAGYLSLLQVATFKGWMEIMYAAVDSTGIEKQPQYEHNLYMYLYFVGFIIFGSFFTLNLFIGVIIDNFNQQKKKLGGQDIFMTEEQKKYYNAMKKLGSKKPQKPIPRPSNKIQGFIFDFVTKQAFDIGIMILICLNMVTMMVETADQDSSVEEILYWINLFFIVIFTGECLLKLIALRYYYFTIGWNIFDFVVVIFSIVGMCLSQIIEKFFVSPTLFRVVRLARIGRVLRLIKGAKGIRTLLFALMMSLPALFNIGLLLFLVMFIYAIFGMSQFAYVKKESGIDDMFNFETFANSMICLFQITTSGGWNYLLFPILNKEPDCDPKKVHPGSSVEGDCGNPSVGIFFFVSYIIISFLVVVNMYIAVILENFSVATEESAEPLGEDDFEMFYEVWEKFDPGATQFIEFSKLFDFAASLEPPLLIPKPNKVQLIAMDLPIVSGDRIHCLDILFAFTKRVLGESDEMDALRVQMEDRFMAANPSKVSYEPITTTLKRKLEEQSAKVIQRAFRHYRLRKPVCNTSYLYRDGDVFPSKTEMAFDKLSLSLTLEKTERSSSTTSPPSYDSVTKPDKYEQEKSEKEEKGKDDKDYRK

SEQ ID NO: 43 - protein, 2005 aa, Pan paniscus
MAQSVLVPPGPDSFRFFTRESLAAIEQRIAEEKAKRPKQERKDEDDENGPKPNSDLEAGKSLPFIYGDIPPEMVSVPLEDLDPFYINKKTFIVLNKGKAISRFSATPALYILTPFNPIRKLAIKILVHSLFNMLIMCTILTNCVFMTMSNPPDWTKNVEYTFTGIYTFESLIKILARGFCLEDFTFLRDPWNWLDFTVITFAYVTEFVDLGNVSALRTFRVLRALKTISVIPGLKTIVGALIQSVKKLSDVMILTVFCLSVFALIGLQLFMGNLRNKCLQWPPDNSSFEINITSFFNNSLDGNGTTFNRTVSIFNWDEYIEDKSHFYFLEGQNDALLCGNSSDAGQCPEGYICVKAGRNPNYGYTSFDTFSWAFLSLFRLMTQDFWENLYQLTLRAAGKTYMIFFVLVIFLGSFYLINLILAVVAMAYEEQNQATLEEAEQKEAEFQQMLEQLKKQQEEAQAAAAAASAESRDFSGAGGIGVFSESSSVASKLSSKSEKELKNRRKKKKQKEQSGEEEKNDRVRKSESEDSIRRKGFRFSLEGSRLTYEKRFSSPHQSLLSIRGSLFSPRRNSRASLFSFRGRAKDIGSENDFADDEHSTFEDNDSRRDSLFVPHRHGERRHSNVSQASRASRVLPILPMNGKMHSAVDCNGVVSLVGGPSTLTSAGQLLPEGTTTETEIRKRRSSSYHVSMDLLEDPTSRQRAMSIASILTNTMEELEESRQKCPPCWYKFANMCLIWDCCKPWLKVKHLVNLVVMDPFVDLAITICIVLNTLFMAMEHYPMTEQFSSVLSVGNLVFTGIFTAEMFLKIIAMDPYYYFQEGWNIFDGFIVSLSLMELGLANVEGLSVLRSFRLLRVFKLAKSWPTLNMLIKIIGNSVGALGNLTLVLAIIVFIFAVVGMQLFGKSYKECVCKISNDCELPRWHMHDFFHSFLIVFRVLCGEWIETMWDCMEVAGQTMCLTVFMMVMVIGNLVVLNLFLALLLSSFSSDNLAATDDDNEMNNLQIAVGRMQKGIDFVKRKIREFIQKAFVRKQKALDEIKPLEDLNNKKDSCISNHTTIEIGKDLNYLKDGNGTTSGIGSSVEKYVVDESDYLSFINNPSLTVTVPIAVGESDFENLNTEEFSSESDMEESKEKLNATSSSEGSTVDIGAPAEGEQPEVEPEESLEPEACFTEDCVRKFKCCQISIEEGKGKLWWNLRKTCYKIVEHNWFETFIVFMILLSSGALAFEDIYIEQRKTIKTMLEYADKVFTYIFILEMLLKWVAYGFQVYFTNAWCWLDFLIVDVSLVSLTANALGYSELGAIKSLRTLRALRPLRALSRFEGMRVVVNALLGAIPSIMNVLLVCLIFWLIFSIMGVNLFAGKFYHCINYTTGEMFDVSVVNNYSECKALIESNQTARWKNVKVNFDNVGLGYLSLLQVATFKGWMDIMYAAVDSRNVELQPKYEDNLYMYLYFVIFIIFGSFFTLNLFIGVIIDNFNQQKKKFGGQDIFMTEEQKKYYNAMKKLGSKKPQKPIPRPANKFQGMVFDFVTKQVFDISIMILICLNMVTMMVETDDQSQEMTNILYWINLVFIVLFTGECVLKLISLRYYYFTIGWNIFDFVVVILSIVGMFLAELIEKYFVSPTLFRVIRLARIGRILRLIKGAKGIRTLLFALMMSLPALFNIGLLLFLVMFIYAIFGMSNFAYVKREVGIDDMFNFETFGNSMICLFQITTSAGWDGLLAPILNSGPPDCDPEKDHPGSSVKGDCGNPSVGIFFFVSYIIISFLVVVNMYIAVILENFSVATEESAEPLSEDDFEMFYEVWEKFDPDATQFIEFAKLSDFADALDPPLLIAKPNKVQLIAMDLPMVSGDRIHCLDILFAFTKRVLGESGEMDALRIQMEERFMASNPSKVSYEPITTTLKRKQEEVSAIIIQRAYRRYLLKQKVKKVSSIYKKDKGKECDGTPIKEDTLIDKLNENSTPEKTDMTPSTTSPPSYDSVTKPEKEKFEKDKSEKEDKGKDIRESKK

SEQ ID NO: 44 - protein, 2005 aa, Macaca mulatta
MAQSVLVPPGPDSFRFFTRESLAAIEQRIAEEKAKRPKQERKDEDDENGPKPNSDLEAGKSLPFIYGDIPPEMVSVPLEDLDPYYINKKTFIVLNKGKAISRFSATPALYILTPFNPIRKLAIKILVHSLFNMLIMCTILTNCVFMTMSNPPDWTKNVEYTFTGIYTFESLIKILARGFCLEDFTFLRDPWNWLDFTVITFAYVTEFVDLGNVSALRTFRVLRALKTISVIPGLKTIVGALIQSVKKLSDVMILTVFCLSVFALIGLQLFMGNLRNKCLQWPPDNSSFEINITSFFNNSLDGNGTTFNRTVSMFNWDEYIEDKSHFYFLEGQNDALLCGNSSDAGQCPEGYICVKAGRNPNYGYTSFDTFSWAFLSLFRLMTQDFWENLYQLTLRAAGKTYMIFFVLVIFLGSFYLINLILAVVAMAYEEQNQATLEEAEQKEAEFQQMLEQLKKQQEEAQAAAAAASAESRDFSGAGGIGVFSESSSVASKLSSKSEKELKNRRKKKKQKEQSGEEEKNDRVRKSESEDSIRRKGFRFSLEGSRLTYEKRFSSPHQSLLSIRGSLFSPRRNSRASLFSFRGRTKDIGSENDFADDEHSTFEDNDSRRDSLFVPHRHGERRHSNVSQASRASRVLPILPMNGKMHSAVDCNGVVSLVGGPSTLTSAGQLLPEGTTTETEIRKRRSSSYHVSMDLLEDPTSRQRAMSIASILTNTMEELEESRQKCPPCWYKFANMCLIWDCCKPWLKVKHLVNLVVMDPFVDLAITICIVLNTLFMAMEHYPMTEQFSSVLSVGNLVFTGIFTAEMFLKIIAMDPYYYFQEGWNIFDGFIVSLSLMELGLANVEGLSVLRSFRLLRVFKLAKSWPTLNMLIKIIGNSVGALGNLTLVLAIIVFIFAVVGMQLFGKSYKECVCKISNDCELPRWHMHDFFHSFLIVFRVLCGEWIETMWDCMEVAGQTMCLTVFMMVMVIGNLVVLNLFLALLLSSFSSDNLAATDDDNEMNNLQIAVGRMQKGIDFVKRKIREFIQKAFVRKQKALDEIKPLEDLNNKKDSCISNHTTIEIGKDLNYLKDGNGTTSGIGSSVEKYVVDESDYMSFINNPSLTVTVPIAVGESDFENLNTEEFSSESDMEESKEKLNATSSSEGSTVDIGAPAEGEQPEVEPEESLEPEACFTEDCVRKFKCCQISIEEGKGKLWWNLRKTCYKIVEHNWFETFIVFMILLSSGALAFEDIYIEQRKTIKTMLEYADKVFTYIFILEMLLKWVAYGFQVYFTNAWCWLDFLIVDVSLVSLTANALGYSELGAIKSLRTLRALRPLRALSRFEGMRVVVNALLGAIPSIMNVLLVCLIFWLIFSIMGVNLFAGKFYHCINYTTGEMFDVSVVNNYSECKALIESNQTARWKNVKVNFDNVGLGYLSLLQVATFKGWMDIMYAAVDSRNVELQPKYEDNLYMYLYFVIFIIFGSFFTLNLFIGVIIDNFNQQKKKFGGQDIFMTEEQKKYYNAMKKLGSKKPQKPIPRPANKFQGMVFDFVTKQVFDISIMILICLNMVTMMVETDDQSQEMTNILYWINLVFIVLFTGECVLKLISLRYYYFTIGWNIFDFVVVILSIVGMFLAELIEKYFVSPTLFRVIRLARIGRILRLIKGAKGIRTLLFALMMSLPALFNIGLLLFLVMFIYAIFGMSNFAYVKREVGIDDMFNFETFGNSMICLFQITTSAGWDGLLAPILNSGPPDCDPEKDHPGSSVKGDCGNPSVGIFFFVSYIIISFLVVVNMYIAVILENFSVATEESAEPLSEDDFEMFYEVWEKFDPDATQFIEFAKLSDFADALDPPLLIAKPNKVQLIAMDLPMVSGDRIHCLDILFAFTKRVLGESGEMDALRIQMEERFMASNPSKVSYEPITTTLKRKQEEVSAIIIQRAYRRYLLKQKVKKVSSIYKKDKGKECDGTPIKEDTLIDKLNENSTPEKTDMTPSTTSPPSYDSVTKPEKEKFEKDKSEKEDKGKDIRESKK

SEQ ID NO: 45 - protein, 1932 aa, Artificial Sequence
  Galeopterus variegates
PEMVSEPLEDLDPYYINKKTFIVLNKGKAISRFSATPALYILTPFNPIRKLAIKILVHSLFNVLIMCTILTNCVFMTMSNPPDWTKNVEYTFTGIYTFESLIKILARGFCLEDFTFLRDPWNWLDFTVITFAYVTEFVDLGNVSALRTFRVLRALKTISVIPGLKTIVGALIQSVKKLSDVMILTVFCLSVFALIGLQLFMGNLRNKCLQWPPDNSSFEINITSFFNNSLDGNGTTFNRTVSMFNWDEYIEDESHFYFLEGQNDALLCGNSSDAGQCPEGYVCVKAGRNPNYGYTSFDTFSWAFLSLFRLMTQDFWENLYQLTLRAAGKTYMIFFVLVIFLGSFYLINLILAVVAMAYEEQNQATLEEAEQKEAEFQQMLEQLKKQQEEAQAAAAAASAESRDFSGAGGIGVFSESSSVASKLSSKSEKELKNRRKKKKQKEQSGEEEKEDGVRKSESEDSIRRKGFRFSLEGSRLTYEKRFSSPHQSLLSIRGSLFSPRRNSRASLFSFRGRAKDIGSENDFADDEHSTFEDNDSRRDSLFVPHRHGERRHSNVSQASRASRLLPTLPMNGKMHSAVDCNGVVSLVGGPSPAGQLLPEGTTTETEIRKRRSSSYHVSMDLLEDPTSRQRAMSIASILTNTMEELEESRQKCPPCWYKFANMCLIWDCCKPWLKVKRLVNLVVMDPFVDLAITICIVLNTLFMAMEHYPMTEQFSSVLSVGNLVFTGIFTAEMFLKIIAMDPYYYFQEGWNIFDGFIVSLSLMELGLANVEGLSVLRSFRLLRVFKLAKSWPTLNMLIKIIGNSVGALGNLTLVLAIIVFIFAVVGMQLFGKSYKECVCKISNDCELPRWHMHDFFHSFLIVFRVLCGEWIETMWDCMEVAGQTMCLTVFMMVMVIGNLVVLNLFLALLLSSFSSDNLAATDDDNEMNNLQIAVGRMQKGIDFVKRKIREFIQKAFVRKQKALDEIKPLEDLNNKKDSCISNHTTIEIGKDLNYLKDGNGTTSGIGSSVEKYVVDESDYMSFINNPSLTVTVPIALGESDFENLNTEEFSSESDMEESKEKLNATSSSEGSTVDIGAPAEGEQPEVEPEESLEPEACFTEDCVRKFKCCQISIEEGKGKLWWNLRKTCYKIVEHNWFETFIVFMILLSSGALAFEDIYIEQRKTIKTMLEYADKVFTYIFILEMLLKWVAYGFQMYFTNAWCWLDFLIVDVSLVSLTANALGYSELGAIKSLRTLRALRPLRALSRFEGMRVVVNALLGAIPSIMNVLLVCLIFWLIFSIMGVNLFAGKFYHCINYTTGEMFDVSVVNNYSECKALIESNQTARWKNVKVNFDNVGLGYLSLLQVATFKGWMDIMYAAVDSRNVELQPKYEDNLYMYLYFVIFIIFGSFFTLNLFIGVIIDNFNQQKKKFGGQDIFMTEEQKKYYNAMKKLGSKKPQKPIPRPANKFQGMVFDFVTKQVFDISIMILICLNMVTMMVETDDQSQEMTNILYWINLVFIVLFTGECVLKLISLRYYYFTIGWNIFDFVVVILSIVGMFLAELIEKYFVSPTLFRVIRLARIGRILRLIKGAKGIRTLLFALMMSLPALFNIGLLLFLVMFIYAIFGMSNFAYVKREVGIDDMFNFETFGNSMICLFQITTSAGWDGLLAPILNSGPPDCDPEKDHPGSSVKGDCGNPSVGIFFFVSYIIISFLVVVNMYIAVILENFSVATEESAEPLSEDDFEMFYEVWEKFDPDATQFIEFAKLSDFADALDPPLLIAKPNKVQLIAMDLPMVSGDRIHCLDILFAFTKRVLGESGEMDALRIQMEERFMASNPSKVSYEPITTTLKRKQEEVSAIIIQRAYRRYLLKQKVKKVSSIYKKDKGKECDGTPIKEDTLIDKLNENSTPEKTDMTPSTTSPPSYDSVTKPEKEKFEKDKSEKEDKGKDIRESKK

SEQ ID NO: 46 - protein, 2006 aa, Bos taurus
MAQSVLVPPGPDSFRFFTRESLAAIEQRIAEEKAKRPKQERKDEDDESGPKPNSDLEAGKSLPFIYGDIPPEMVSEPLEDLDPYYINKKTFIVLNKGKAISRFSATPALYILTPFNPIRKLAIKILVHSLFNVLIMCTILTNCVFMTMSNPPDWTKNVEYTFTGIYTFESLIKILARGFCLEDFTFLRDPWNWLDFTVITFAYVTEFVDLGNVSALRTFRVLRALKTISVIPGLKTIVGALIQSVKKLSDVMILTVFCLSVFALIGLQLFMGNLRNKCLQWPPDNSSFELNITSFFNNSLDGNGTTFNRTVSMFNWDEYIEDKSHFYFLEGQNDALLCGNSSDAGQCPEGYICVKAGRNPNYGYTSFDTFSWAFLSLFRLMTQDFWENLYQLTLRAAGKTYMIFFVLVIFLGSFYLINLILAVVAMAYEEQNQATLEEAEQKEAEFQQMLEQLKKQQEEAQAAAAAASAESREFSGAGGIGVFSESSSVASKLSSKSEKELKNRRKKKKQKEQSGEEEKEDGVRKSESEDSIRRKGFRFSLEGSRLTYEKRFSSPHQSLLSIRGSLFSPRRNSRASLFSFRGRAKDIGSENDFADDEHSTFEDNDSRRDSLFVPHRHGERRHSNVSQASRASRVLPILPMNGKMHSAVDCNGVVSLVGGPSALTSPAGQLLPEGTTTETEIRKRRSSSYHVSMDLLEDPTARQRAMSMASILTNTMEELEESRQKCPPCWYKFANMCLIWDCCKPWLKVKHVVNLVVMDPFVDLAITICIVLNTLFMAMEHYPMTEQFSSVLSVGNLVFTGIFTAEMFLKIIAMDPYYYFQEGWNIFDGLIVSLSLMELGLANVEGLSVLRSFRLLRVFKLAKSWPTLNMLIKIIGNSVGALGNLTLVLAIIVFIFAVVGMQLFGKSYKECVCKISNDCELPRWHMHDFFHSFLIVFRVLCGEWIETMWDCMEVAGQTMCLTVFMMVMVIGNLVVLNLFLALLLSSFSSDNLAATDDDNEMNNLQIAVGRMQKGIDFVKRKIREFIQKAFVRKQKALDEIKPLEDLNNKKDSCISNHTTIEIGKDLNYLKDGNGTTSGIGSSVEKYVVDESDYMSFINNPSLTVTVPIAVGESDFENLNTEEFSSESDMEESKEKLNATSSSEGSTVDIGAPAEGEQPEAEPEESLEPEACFTEDCVRKFKCCQISIEEGKGKLWWNLRKTCYKIVEHNWFETFIVFMILVSSGALAFEDIYIEQRKTIKTMLEYADKVFTYIFILEMLLKWVAYGFQVYFTNAWCWLDFLIVDVSLVSLTANALGYSELGAIKSLRTLRALRPLRALSRFEGMRVVVNALLGAIPSIMNVLLVCLIFWLIFSIMGVNLFAGKFYHCINYTTGEMFDVSVVNNYSECKALIDSNQTARWKNVKVNFDNVGLGYLSLLQVATFKGWMDIMYAAVDSRNVELQPKYEDNLYMYLYFVIFIIFGSFFTLNLFIGVIIDNFNQQKKKFGGQDIFMTEEQKKYYNAMKKLGSKKPQKPIPRPANKFQGMVFDFVTKQVFDISIMILICLNMVTMMVETDDQSQEMTNILYWINLVFIVLFTGECVLKLISLRYYYFTIGWNIFDFVVVILSIVGMFLAELIEKYFVSPTLFRVIRLARIGRILRLIKGAKGIRTLLFALMMSLPALFNIGLLLFLVMFIYAIFGMSNFAYVKREVGIDDMFNFETFGNSMICLFQITTSAGWDGLLAPILNSGPPDCDPEKDHPGSSVKGDCGNPSVGIFFFVSYIIISFLVVVNMYIAVILENFSVATEESAEPLSEDDFEMFYEVWEKFDPDATQFIEFSKLSDFAAALDPPLLIAKPNKVQLIAMDLPMVSGDRIHCLDILFAFTKRVLGESGEMDALRIQMEERFMASNPSKVSYEPITTTLKRKQEEVSAIVIQRAYRRYLLKQKVKKVSCIYKKDKGKEGEGTPIKEDILIDKLNENSTPEKTDMTPSTTSPPSYDSVTKPEKEKFEKDKSEKEDKGKDIRESKK

SEQ ID NO: 47 - protein, 2006 aa, Ovis aries
MAQSVLVPPGPDSFRFFTRESLAAIEQRIAEEKAKRPKQERKDEDDESGPKPNSDLEAGKSLPFIYGDIPPEMVSEPLEDLDPYYINKKTFIVLNKGKAISRFSATPALYILTPFNPIRKLAIKILVHSLFNVLIMCTILTNCVFMTMSNPPDWTKNVEYTFTGIYTFESLIKILARGFCLEDFTFLRDPWNWLDFTVITFAYVTEFVDLGNVSALRTFRVLRALKTISVIPGLKTIVGALIQSVKKLSDVMILTVFCLSVFALIGLQLFMGNLRNKCLQWPPDNSSFELNITSFFNNSLDGNGTTFNRTVSMFNWDEYIEDKSHFYFLEGQNDALLCGNSSDAGQCPEGYICVKAGRNPNYGYTSFDTFSWAFLSLFRLMTQDFWENLYQLTLRAAGKTYMIFFVLVIFLGSFYLINLILAVVAMAYEEQNQATLEEAEQKEAEFQQMLEQLKKQQEEAQAAAAAASAESRDFSGAGGIGVFSESSSVASKLSSKSEKELKNRRKKKKQKEQSGEEEKEDGVHKSESEDSIRRKGFRFSLEGSRLTYEKRFSSPHQSLLSIRGSLFSPRRNSRASLFSFRGRAKDIGSENDFADDEHSTFEDNDSRRDSLFVPHRHGERRHSNVSQASRASRVLPILPMNGKMHSAVDCNGVVSLVGGPSALTSPAGQLLPEGTTTETEIRKRRSSSYHVSMDLLEDPTARQRAMSMASILTNTMEELEESRQKCPPCWYKFANMCLIWDCCKPWLKVKHVVNLVVMDPFVDLAITICIVLNTLFMAMEHYPMTEQFSSVLSVGNLVFTGIFTAEMFLKIIAMDPYYYFQEGWNIFDGLIVSLSLMELGLANVEGLSVLRSFRLLRVFKLAKSWPTLNMLIKIIGNSVGALGNLTLVLAIIVFIFAVVGMQLFGKSYKECVCKISNDCELPRWHMHDFFHSFLIVFRVLCGEWIETMWDCMEVAGQTMCLTVFMMVMVIGNLVVLNLFLALLLSSFSSDNLAATDDDNEMNNLQIAVGRMQKGIDFVKRKIREFIQKAFVRKQKALDEIKPLEDLNNKKDSCISNHTTIEIGKDLNYLKDGNGTTSGIGSSVEKYVVDESDYMSFINNPSLTVTVPIAVGESDFENLNTEEFSSESDMEESKEKLNATSSSEGSTVDIGAPAEGEQPEAEPEESLEPEACFTEDCVRKFKCCQISIEEGKGKLWWNLRKTCYKIVEHNWFETFIVFMILVSSGALAFEDIYIEQRKTIKTMLEYADKVFTYIFILEMLLKWVAYGFQVYFTNAWCWLDFLIVDVSLVSLTANALGYSELGAIKSLRTLRALRPLRALSRFEGMRVVVNALLGAIPSIMNVLLVCLIFWLIFSIMGVNLFAGKFYHCINYTTGEMFDVSVVNNYSECKALIDSNQTARWKNVKVNFDNVGLGYLSLLQVATFKGWMDIMYAAVDSRNVELQPKYEDNLYMYLYFVIFIIFGSFFTLNLFIGVIIDNFNQQKKKFGGQDIFMTEEQKKYYNAMKKLGSKKPQKPIPRPANKFQGMVFDFVTKQVFDISIMILICLNMVTMMVETDDQSQEMTNILYWINLVFIVLFTGECVLKLISLRYYYFTIGWNIFDFVVVILSIVGMFLAELIEKYFVSPTLFRVIRLARIGRILRLIKGAKGIRTLLFALMMSLPALFNIGLLLFLVMFIYAIFGMSNFAYVKREVGIDDMFNFETFGNSMICLFQITTSAGWDGLLAPILNSGPPDCDPEKDHPGSSVKGDCGNPSVGIFFFVSYIIISFLVVVNMYIAVILENFSVATEESAEPLSEDDFEMFYEVWEKFDPDATQFIEFSKLSDFAAALDPPLLIAKPNKVQLIAMDLPMVSGDRIHCLDILFAFTKRVLGESGEMDALRIQMEERFMASNPSKVSYEPITTTLKRKQEEVSAIVIQRAYRRYLLKQKVKKVSCIYKKDKGKEGEGTPIKEDILIDKLNENSTPEKTDMTPSTTSPPSYDSVTKPEKEKFEKDKSEKEDKGKDIRESKK

SEQ ID NO: 48 - protein, 2006 aa, Camelus dromedarius
MAQSVLVPPGPDSFRFFTRESLAAIEQRIAEEKAKRPKQERKDEDDENGPKPNSDLEAGKSLPFIYGDIPPEMVSEPLEDLDPYYINKKTFIVLNKGKAISRFSATPALYILTPFNPIRKLAIKILVHSLFNVLIMCTILTNCVFMTMSNPPDWTKNVEYTFTGIYTFESLIKILARGFCLEDFTFLRDPWNWLDFTVITFAYVTEFVDLGNVSALRTFRVLRALKTISVIPGLKTIVGALIQSVKKLSDVMILTVFCLSVFALIGLQLFMGNLRNKCLQWPPDNSSLEINITSFFNNSLDGNGTTFNRTVSMFNWDDYIEDKSHFYFLEGQNDALLCGNSSDAGQCPEGYICVKAGRNPNYGYTSFDTFSWAFLSLFRLMTQDFWENLYQLTLRAAGKTYMIFFVLVIFLGSFYLINLILAVVAMAYEEQNQATLEEAEQKEAEFQQMLEQLKKQQEEAQAAAAAASAESRDFSGAGGIGVFSESSSVASKLSSKSEKELKNRRKKKKQKEQSGEEEKEDGVHKSESEDSIRRKGFRFSLEGSRLTYEKRFSSPHQSLLSIRGSLFSPRRNSRASLFSFRGRAKDIGSENDFADDEHSTFEDNDSRRDSLFVPHRHGERRHSNVSQASRASRVLPILPMNGKMHSAVDCNGVVSLVGGPSALTSPAGQLLPEGTTTETEIRKRRSSSYHVSMDLLEDPTARQRAMSMASILTNTMEELEESRQKCPPCWYKFANTCLIWDCCKPWLKVKHLVNLVVMDPFVDLAITICIVLNTLFMAMEHYPMTEQFSSVLSVGNLVFTGIFTAEMFLKIIAMDPYYYFQEGWNIFDGLIVSLSLMELGLANVEGLSVLRSFRLLRVFKLAKSWPTLNMLIKIIGNSVGALGNLTLVLAIIVFIFAVVGMQLFGKSYKECVCKISNDCELPRWHMHDFFHSFLIVFRVLCGEWIETMWDCMEVAGQTMCLTVFMMVMVIGNLVVLNLFLALLLSSFSSDNLAATDDDNEMNNLQIAVGRMQKGIDYVKRKIREFIQKAFVRKQKALDEIKPLEDLNNKKDSCISNHTTIEIGKDLNYLKDGNGTTSGIGSSVEKYVVDESDYMSFINNPSLTVTVPIAVGESDFENLNTEEFSSESDMEESKEKLNATSSSEGSTVDIGAPAEGEQPEVEPEESLEPEACFTEDCVRKFKCCQISIEEGKGKLWWNVRKTCYKIVEHNWFETFIVFMILLSSGALAFEDIYIEQRKTIKTMLEYADKVFTYIFILEMLLKWVAYGFQVYFTNAWCWLDFLIVDVSLVSLTANALGYSELGAIKSLRTLRALRPLRALSRFEGMRVVVNALLGAIPSIMNVLLVCLIFWLIFSIMGVNLFAGKFYHCINYTTGEMFDVSVVNNYSECKALIESNQTARWKNVKVNFDNVGLGYLSLLQVATFKGWMDIMYAAVDSRNVELQPKYEDNLYMYLYFVIFIIFGSFFTLNLFIGVIIDNFNQQKKKFGGQDIFMTEEQKKYYNAMKKLGSKKPQKPIPRPANKFQGMVFDFVTKQVFDISIMILICLNMVTMMVETDDQSQEMTNILYWINLVFIVLFTGECVLKLISLRYYYFTIGWNIFDFVVVILSIVGMFLAELIEKYFVSPTLFRVIRLARIGRILRLIKGAKGIRTLLFALMMSLPALFNIGLLLFLVMFIYAIFGMSNFAYVKREVGIDDMFNFETFGNSMICLFQITTSAGWDGLLAPILNSGPPDCDPEKDHPGSSVKGDCGNPSVGIFFFVSYIIISFLVVVNMYIAVILENFSVATEESAEPLSEDDFEMFYEVWEKFDPDATQFIEFSKLSDFAAALDPPLLIAKPNKVQLIAMDLPMVSGDRIHCLDILFAFTKRVLGESGEMDALRIQMEERFMASNPSKVSYEPITTTLKRKQEEVSAIVIQRAYRRYLLKQKVKKVSCIYKKDKGKEGDGTPIKEDTLIDKLNENSTPEKTDGTPSTTSPPSYDSVTKPEKEKFEKDKSEKEDKGKDIRESKK

SEQ ID NO: 49 - protein, 2006 aa, Orcinus orca
MAQSVLVPPGPDSFRFFTRESLAAIEQRIAEEKAKRPKQERKDEDDENGPKPNSDLEAGKSLPFIYGDIPPEMVSEPLEDLDPYYINKKTFIVLNKGKAISRFSATPALYILTPFNPIRKLAIKILVHSLFNVLIMCTILTNCVFMTMSNPPDWTKNVEYTFTGIYTFESLIKILARGFCLEDFTFLRDPWNWLDFTVITFAYVTEFVDLGNVSALRTFRVLRALKTISVIPGLKTIVGALIQSVKKLSDVMILTVFCLSVFALIGLQLFMGNLRNKCLQWPPDNSSFEINITSFFNNSLDGNGTTFNRTVSMFNWDEYIEDKSHFYFLEGQNDALLCGNSSDAGQCPEGYICVKAGRNPNYGYTSFDTFSWAFLSLFRLMTQDFWENLYQLTLRAAGKTYMIFFVLVIFLGSFYLINLILAVVAMAYEEQNQATLEEAEQKEAEFQQMLEQLKKQQEEAQAAAAAASAESRDFSGAGGIGVFSESSSVASKLSSKSEKELKNRRKKKKQKEQSGEEEKEDGVHKSESEDSIRRKGFRFSLEGSRLTYEKRFSSPHQSLLSIRGSLFSPRRNSRASLFSFRGRAKDIGSENDFADDEHSTFEDNDSRRDSLFVPHRHGERRPSNVSQASRASRVLPVLPVNGKMHSAVDCNGVVSLVGGPSALTSPAGQLLPEGTTTETEIRKRRSSSYHVSMDLLEDPTAKQRATSMASILTNTMEELEESRQKCPPCWYKFANMCLIWDCCKPWLKVKHLVNLVVMDPFVDLAITICIVLNTLFMAMEHYPMTEQFSSVLSVGNLVFTGIFTAEMFLKIIAMDPYYYFQEGWNIFDGLIVSLSLMELGLANVEGLSVLRSFRLLRVFKLAKSWPTLNMLIKIIGNSVGALGNLTLVLAIIVFIFAVVGMQLFGKSYKECVCKISNDCELPRWHMHDFFHSFLIVFRVLCGEWIETMWDCMEVAGQTMCLTVFMMVMVIGNLVVLNLFLALLLSSFSSDNLAATDDDNEMNNLQIAVGRMQKGIDYVKRKIREFIQKAFVRKQKALDEIKPLEDLNNKKDSCISNHTTIEIGKDLNYLKDGNGTTSGIGSSVEKYVVDESDYMSFINNPSLTVTVPIAVGESDFENLNTEEFSSESDMEESKEKLNATSSSEGSTVDIGAPAEGEQPEVEPEESLEPEACFTEDCVRKFKCCQISIEEGKGKLWWNLRKTCYKIVEHNWFETFIVFMILLSSGALAFEDIYIEQRKTIKTMLEYADKVFTYIFILEMLLKWVAYGFQVYFTNAWCWLDFLIVDVSLVSLTANALGYSELGAIKSLRTLRALRPLRALSRFEGMRVVVNALLGAIPSIMNVLLVCLIFWLIFSIMGVNLFAGKFYHCINYTTGEMFDVSVVNNYSECKALIESNQTARWKNVKVNFDNVGLGYLSLLQVATFKGWMDIMYAAVDSRNVELQPKYEDNLYMYLYFVIFIIFGSFFTLNLFIGVIIDNFNQQKKKFGGQDIFMTEEQKKYYNAMKKLGSKKPQKPIPRPANKFQGMVFDFVTKQVFDISIMILICLNMVTMMVETDDQSQEMTNILYWINLVFIVLFTGECVLKLISLRYYYFTIGWNIFDFVVVILSIVGMFLAELIEKYFVSPTLFRVIRLARIGRILRLIKGAKGIRTLLFALMMSLPALFNIGLLLFLVMFIYAIFGMSNFAYVKREVGIDDMFNFETFGNSMICLFQITTSAGWDGLLAPILNSGPPDCDPEKDHPGSSVKGDCGNPSVGIFFFVSYIIISFLVVVNMYIAVILENFSVATEESAEPLSEDDFEMFYEVWEKFDPDATQFIEFSKLSDFAAALDPPLLIAKPNKVQLIAMDLPMVSGDRIHCLDILFAFTKRVLGESGEMDALRIQMEERFMASNPSKVSYEPITTTLKRKQEEVSAIVIQRAYRRYLLKQKVKKVSCIYKKDKGKEADGTPIKEDILTDKLNENSTPEKTDVTPSTTSPPSYDSVTKPEKEKFEKDKSEKEDKGKDIRESKK

SEQ ID NO: 50 - protein, 2006 aa, Equus caballus
MAQSVLVPPGPDSFRFFTRESLAAIEQRIAEEKAKRPKQERKDEDDENGPKPNSDLEAGKSLPFIYGDIPPEMVSEPLEDLDPYYINKKTFIVLNKGKAISRFSATSALYILTPFNPIRKLAIKILVHSLFNVLIMCTILTNCVFMTMSNPPDWTKNVEYTFTGIYTFESLIKILARGFCLEDFTFLRDPWNWLDFTVITFAYVTEFVDLGNVSALRTFRVLRALKTISVIPGLKTIVGALIQSVKKLSDVMILTVFCLSVFALIGLQLFMGNLRNKCLQWPPDNSSFEINITSFFNNSLDGNGTIFNRTVSMFNWDDYIEDKSHFYFLEGQNDALLCGNSSDAGQCPEGYICVKAGRNPNYGYTSFDTFSWAFLSLFRLMTQDFWENLYQLTLRAAGKTYMIFFVLVIFLGSFYLINLILAVVAMAYEEQNQATLEEAEQKEAEFQQMLEQLKKQQEEAQAAAAAASAESRDFSGAGGVGVFSESSSVASKLSSKSEKELKNRRKKKKQKEQSGEEEKEDGVRKSESEDSIRRKGFRFSLEGSRLTYEKRFSSPHQSLLSIRGSLFSPRRNSRASLFSFRGRAKDIGSENDFADDEHSTFEDNDSRRDSLFVPHRHGERRHSNVSQASRASRVLPILPMNGKMHSAVDCNGVVSLVGGPSALTSPAGQLLPEGTTTETEIRKRRSSSYHVSMDLLEDPTARQRAMSMASILTNTMEELEESRQKCPPCWYKFANMCLIWDCCKPWLKVKHLVNLVVMDPFVDLAITICIVLNTLFMAMEHYPMTEQFSSVLSVGNLVFTGIFTAEMFLKIIAMDPYYYFQEGWNIFDGFIVSLSLMELGLANVEGLSVLRSFRLLRVFKLAKSWPTLNMLIKIIGNSVGALGNLTLVLAIIVFIFAVVGMQLFGKSYKECVCKISNDCELPRWHMHDFFHSFLIVFRVLCGEWIETMWDCMEVAGQTMCLTVFMMVMVIGNLVVLNLFLALLLSSFSSDNLAATDDDNEMNNLQIAVGRMQKGIDYVKRKLREFIQKAFVRKQKALDEIKPLEDLNNKKDSCISNHTTIEIGKDLNYLKDGNGTTSGIGSSVEKYVVDESDYMSFINNPSLTVTVPIAVGESDFENLNTEEFSSESDMEESKEKLNATSSSEGSTVDIGAPAEGEQPEAEPEESLEPEACFTEDCVRKFKCCQISIEEGKGKLWWNVRKTCYKIVEHNWFETFIVFMILLSSGALAFEDIYIEQRKTIKTMLEYADKVFTYIFILEMLLKWVAYGFQVYFTNAWCWLDFLIVDVSLVSLTANALGYSELGAIKSLRTLRALRPLRALSRFEGMRVVVNALLGAIPSIMNVLLVCLIFWLIFSIMGVNLFAGKFYHCINYTTGEMFDVSVVNNYSECKALIESNQTARWKNVKVNFDNVGLGYLSLLQVATFKGWMDIMYAAVDSRNVELQPKYEDNLYMYLYFVIFIIFGSFFTLNLFIGVIIDNFNQQKKKFGGQDIFMTEEQKKYYNAMKKLGSKKPQKPIPRPANKFQGMVFDFVTKQVFDISIMILICLNMVTMMVETDDQSQEMTNILYWINLVFIVLFTGECVLKLISLRYYYFTIGWNIFDFVVVILSIVGMFLAELIEKYFVSPTLFRVIRLARIGRILRLIKGAKGIRTLLFALMMSLPALFNIGLLLFLVMFIYAIFGMSNFAYVKREVGIDDMFNFETFGNSMICLFQITTSAGWDGLLAPILNSGPPDCDPEKDHPGSSVKGDCGNPSVGIFFFVSYIIISFLVVVNMYIAVILENFSVATEESAEPLSEDDFEMFYEVWEKFDPDATQFIEFSKLSDFAAALDPPLLIAKPNKVQLIAMDLPMVSGDRIHCLDILFAFTKRVLGESGEMDALRIQMEERFMASNPSKVSYEPITTTLKRKQEEVSAIVIQRAYRRYLLKQKVKKVSCIYKKDKVKEGDGTPIKEDILIDKLNENSTPEKTDVTPSTTSPPSYDSVTKPEKEKFEKDKSEKEDKGKDIRESKK

SEQ ID NO: 51 - protein, 2006 aa, Mus musculus
MAQSVLVPPGPDSFRFFTRESLAAIEQRIAEEKAKRPKQERKDEDDENGPKPNSDLEAGKSLPFIYGDIPPEMVSEPLEDLDPYYINKKTFIVLNKGKAISRFSATSALYILTPFNPIRKLAIKILVHSLFNVLIMCTILTNCVFMTMSNPPDWTKNVEYTFTGIYTFESLIKILARGFCLEDFTFLRDPWNWLDFTVITFAYVTEFVNLGNVSALRTFRVLRALKTISVIPGLKTIVGALIQSVKKLSDVMILTVFCLSVFALIGLQLFMGNLRNKCLQWPPDNSTFEINITSFFNNSLDWNGTAFNRTMNMFNWDEYIEDKSHFYFLEGQNDALLCGNSSDAGQCPEGYICVKAGRNPNYGYTSFDTFSWAFLSLFRLMTQDFWENLYQLTLRAAGKTYMIFFVLVIFLGSFYLINLILAVVAMAYEEQNQATLEEAEQKEAEFQQMLEQLKKQQEEAQAAAAAASAESRDFSGAGGIGVFSESSSVASKLSSKSEKELKNRRKKKKQKEQAGEEEKEDAVRKSASEDSIRKKGFRFSLEGSRLTYEKRFSSPHQSLLSIRGSLFSPRRNSRASLFSFKGRVKDIGSENDFADDEHSTFEDNDSRRDSLFVPHRHGERRPSNVSQASRASRGIPTLPMNGKMHSAVDCNGVVSLVGGPSALTSPVGQLLPEGTTTETEIRKRRSSSYHVSMDLLEDPTSRQRAMSMASILTNTMEELEESRQKCPPCWYKFANMCLIWDCCKPWLKVKHVVNLVVMDPFVDLAITICIVLNTLFMAMEHYPMTEQFSSVLSVGNLVFTGIFTAEMFLKIIAMDPYYYFQEGWNIFDGFIVSLSLMELGLANVEGLSVLRSFRLLRVFKLAKSWPTLNMLIKIIGNSVGALGNLTLVLAIIVFIFAVVGMQLFGKSYKECVCKISNDCELPRWHMHDFFHSFLIVFRVLCGEWIETMWDCMEVAGQTMCLTVFMMVMVIGNLVVLNLFLALLLSSFSSDNLAATDDDNEMNNLQIAVGRMQKGIDFVKRKIREFIQKAFVRKQKALDEIKPLEDLNNKKDSCISNHTTIEIGKDLNYLKDGNGTTSGIGSSVEKYVVDESDYMSFINNPSLTVTVPIAVGESDFENLNTEEFSSESDMEESKEKLNATSSSEGSTVDIGAPAEGEQPEAEPEESLEPEACFTEDCVRKFKCCQISIEEGKGKLWWNLRKTCYKIVEHNWFETFIVFMILLSSGALAFEDIYIEQRKTIKTMLEYADKVFTYIFILEMLLKWVAYGFQMYFTNAWCWLDFLIVDVSLVSLTANALGYSELGAIKSLRTLRALRPLRALSRFEGMRVVVNALLGAIPSIMNVLLVCLIFWLIFSIMGVNLFAGKFYHCINYTTGEMFDVSVVNNYSECQALIESNQTARWKNVKVNFDNVGLGYLSLLQVATFKGWMDIMYAAVDSRNVELQPKYEDNLYMYLYFVIFIIFGSFFTLNLFIGVIIDNFNQQKKKFGGQDIFMTEEQKKYYNAMKKLGSKKPQKPIPRPANKFQGMVFDFVTKQVFDISIMILICLNMVTMMVETDDQSQEMTNILYWINLVFIVLFTGECVLKLISLRHYYFTIGWNIFDFVVVILSIVGMFLAELIEKYFVSPTLFRVIRLARIGRILRLIKGAKGIRTLLFALMMSLPALFNIGLLLFLVMFIYAIFGMSNFAYVKREVGIDDMFNFETFGNSMICLFQITTSAGWDGLLAPILNSGPPDCDPEKDHPGSSVKGDCGNPSVGIFFFVSYIIISFLVVVNMYIAVILENFSVATEESAEPLSEDDFEMFYEVWEKFDPDATQFIEFCKLSDFAAALDPPLLIAKPNKVQLIAMDLPMVSGDRIHCLDILFAFTKRVLGESGEMDALRIQMEERFMASNPSKVSYEPITTTLKRKQEEVSAIVIQRAYRRYLLKQKVKKVSSIYKKDKGKEDEGTPIKEDIITDKLNENSTPEKTDVTPSTTSPPSYDSVTKPEKEKFEKDKSEKEDKGKDIRESKK

SEQ ID NO: 52 - protein, 2005 aa, Rattus norvegicus
MARSVLVPPGPDSFRFFTRESLAAIEQRIAEEKAKRPKQERKDEDDENGPKPNSDLEAGKSLPFIYGDIPPEMVSEPLEDLDPYYINKKTFIVLNKGKAISRFSATSALYILTPFNPIRKLAIKILVHSLFNVLIMCTILTNCVFMTMSNPPDWTKNVEYTFTGIYTFESLIKILARGFCLEDFTFLRNPWNWLDFTVITFAYVTEFVNLGNVSALRTFRVLRALKTISVIPGLKTIVGALIQSVKKLSDVMILTVFCLSVFALIGLQLFMGNLRNKCLQWPPDNSTFEINITSFFNNSLDWNGTAFNRTVNMFNWDEYIEDKSHFYFLEGQNDALLCGNSSDAGQCPEGYICVKAGRNPNYGYTSFDTFSWAFLSLFRLMTQDFWENLYQLTLRAAGKTYMIFFVLVIFLGSFYLINLILAVVAMAYEEQNQATLEEAEQKEAEFQQMLEQLKKQQEEAQAAAAAASAESRDFSGAGGIGVFSESSSVASKLSSKSEKELKNRRKKKKQKEQAGEEEKEDAVRKSASEDSIRKKGFQFSLEGSRLTYEKRFSSPHQSLLSIRGSLFSPRRNSRASLFNFKGRVKDIGSENDFADDEHSTFEDNDSRRDSLFVPHRHGERRPSNVSQASRASRGIPTLPMNGKMHSAVDCNGVVSLVGGPSALTSPVGQLLPEGTTTETEIRKRRSSSYHVSMDLLEDPSRQRAMSMASILTNTMEELEESRQKCPPCWYKFANMCLIWDCCKPWLKVKHVVNLVVMDPFVDLAITICIVLNTLFMAMEHYPMTEQFSSVLSVGNLVFTGIFTAEMFLKIIAMDPYYYFQEGWNIFDGFIVSLSLMELGLANVEGLSVLRSFRLLRVFKLAKSWPTLNMLIKIIGNSVGALGNLTLVLAIIVFIFAVVGMQLFGKSYKECVCKISNDCELPRWHMHHFFHSFLIVFRVLCGEWIETMWDCMEVAGQTMCLTVFMMVMVIGNLVVLNLFLALLLSSFSSDNLAATDDDNEMNNLQIAVGRMQKGIDFVKRKIREFIQKAFVRKQKALDEIKPLEDLNNKKDSCISNHTTIEIGKDLNYLKDGNGTTSGIGSSVEKYVVDESDYMSFINNPSLTVTVPIALGESDFENLNTEEFSSESDMEESKEKLNATSSSEGSTVDIGAPAEGEQPEAEPEESLEPEACFTEDCVRKFKCCQISIEEGKGKLWWNLRKTCYKIVEHNWFETFIVFMILLSSGALAFEDIYIEQRKTIKTMLEYADKVFTYIFILEMLLKWVAYGFQMYFTNAWCWLDFLIVDVSLVSLTANALGYSELGAIKSLRTLRALRPLRALSRFEGMRVVVNALLGAIPSIMNVLLVCLIFWLIFSIMGVNLFAGKFYHCINYTTGEMFDVSVVNNYSECQALIESNQTARWKNVKVNFDNVGLGYLSLLQVATFKGWMDIMYAAVDSRNVELQPKYEDNLYMYLYFVIFIIFGSFFTLNLFIGVIIDNFNQQKKKFGGQDIFMTEEQKKYYNAMKKLGSKKPQKPIPRPANKFQGMVFDFVTKQVFDISIMILICLNMVTMMVETDDQSQEMTNILYWINLVFIVLFTGECVLKLISLRHYYFTIGWNIFDFVVVILSIVGMFLAELIEKYFVSPTLFRVIRLARIGRILRLIKGAKGIRTLLFALMMSLPALFNIGLLLFLVMFIYAIFGMSNFAYVKREVGIDDMFNFETFGNSMICLFQITTSAGWDGLLAPILNSGPPDCDPEKDHPGSSVKGDCGNPSVGIFFFVSYIIISFLVVVNMYIAVILENFSVATEESAEPLSEDDFEMFYEVWEKFDPDATQFIEFCKLSDFAAALDPPLLIAKPNKVQLIAMDLPMVSGDRIHCLDILFAFTKRVLGESGEMDALRIQMEERFMASNPSKVSYEPITTTLKRKQEEVSAIVIQRAYRRYLLKQKVKKVSSIYKKDKGKEDEGTPIKEDIITDKLNENSTPEKTDVTPSTTSPPSYDSVTKPEKEKFEKDKSEKEDKGKDIRESKK

SEQ ID NO: 53 - protein, 2021 aa, Oryctolagus cuniculus
MAQSVLVPPGPDSFRFFTRESLAAIEQRIAEEKAKRPKQERKDEDDENGPKPNSDLEAGKSLPFIYGDIPPEMVSEPLEDLDPYYINKKTFIVLNKGKAISRFSATPALYILTPFNPIRKLAIKILVHSLFNVLIMCTILTNCVFMTMSNPPDWTKNVEYTFTGIYTFESLIKILARGFCLEDFTFLRDPWNWLDFTVITFAYVTEFVDLGNVSALRTFRVLRALKTISVIPGLKTIVGALIQSVKKLSDVMILTVFCLSVFALIGLQLFMGNLRNKCLQWPPDNSSFEINVTSFFNNSLDGNGTTFNRTMSIFNWDEYIEDKSHFYFLEGQNDALLCGNSSDAGQCPEGYICVKAGRNPNYGYTSFDTFSWAFLSLFRLMTQDFWENLYQLTLRAAGKTYMIFFVLVIFLGSFYLINLILAVVAMAYEEQNQATLEEAEQKEAEFQQMLEQLKKQQEEAQAAAAAASAESREFSGAGGVGVFSESSSVASKLSSKSEKELKNRRKKKKQKEQSGEEEKEDGVRKSESEDSIRRKGFRFSLEGSRLTYEKRFSSPHQSLLSIRGSLFSPRRNSRASLFSFRGRTKDVGSENDFADDEHSTFEDNDSRRDSLFVPHRHGERRHSNVSQASRTSRVLPILPMNGKMHSAVDCNGVVSLVGGPSALTSPTGQLLPEGTTTETEIRKRRSSSYHVSMDLLEDPTSRQRAMSIASILTNTMEELEESRQKCPPCWYKFANMCLIWDCCKPWLKVKHLVNLVVMDPFVDLAITICIVLNTLFMAMEHYPMTEQFSSVLSVGNLVFTGIFTAEMFLKIIAMDPYYYFQEGWNIFDGFIVSLSLMELGLANVEGLSVLRSFRLLRVFKLAKSWPTLNMLIKIIGNSVGALGNLTLVLAIIVFIFAVVGMQLFGKSYKECVCKISNDCELPRWHMHDFFHSFLIVFRVLCGEWIETMWDCMEVAGQTMCLTVFMMVMVIGNLVVLNLFLALLLSSFSSDNLAATDDDNEMNNLQIAVGRMQKGIDFVKRKIREFIQKAFVRKQKALDEIKPLEDLNNKKDSCISNHTTIEIGKDLNYLKDGNGTTSGIGSSVEKYVVDESDYMSFINNPSLTVTVPIAVGESDFENLNTEEFSSESDMEESKEIKEDIETLSCGIDFQKLNATSSSEGSTVDIGAPAEGEQPEAEPEESLEPEACFTEDCVRKFKCCQISIEEGKGKLWWNLRKTCYKIVEHNWFETFIVFMILLSSGALAFEDIYIEQRKTIKTMLEYADKVFTYIFILEMLLKWVAYGFQMYFTNAWCWLDFLIVDVSLVSLTANALGYSELGAIKSLRTLRALRPLRALSRFEGMRVVVNALLGAIPSIMNVLLVCLIFWLIFSIMGVNLFAGKFYHCINFTTGEMFDVSVVNNYSECKALIESNQTARWKNVKVNFDNVGLGYLSLLQVATFKGWMDIMYAAVDSRNVELQPKYEDNLYMYLYFVIFIIFGSFFTLNLFIGVIIDNFNQQKKKFGGQDIFMTEEQKKYYNAMKKLGSKKPQKPIPRPANKFQGMVFDFVTKQVFDISIMILICLNMVTMMVETDDQSQEMTNILYWINLVFIVLFTGECVLKLISLRYYYFTIGWNIFDFVVVILSIVGMFLAELIEKYFVSPTLFRVIRLARIGRILRLIKGAKGIRTLLFALMMSLPALFNIGLLLFLVMFIYAIFGMSNFAYVKREVGIDDMFNFETFGNSMICLFQITTSAGWDGLLAPILNSGPPDCDPEKDHPGSSVKGDCGNPSVGIFFFVSYIIISFLVVVNMYIAVILENFSVATEESAEPLSEDDFEMFYEVWEKFDPDATQFIEFSKLSDFAAALDPPLLIAKPNKVQLIAMDLPMVSGDRIHCLDILFAFTKRVLGESGEMDALRIQMEERFMASNPSKVSYEPITTTLKRKQEEVSAIVIQRAYRRYLLKQKVKKVSSIYKKDKGKEGDGTPIKEDILIDKLNENSTPEKTDMTPSTTSPPSYDSVTKPEKEKFEKDKSEKEDKGKDSRESKK

SEQ ID NO: 54 - protein, 2006 aa, Gallus gallus
MAQSVLVPPGPDSFRYFTRESLAAIEQRINEEKAKKSKQERKDDDDEDGPKPNSDLEAGKTLPFIYGDIPPGMVSEPLEDLDPYYINKKTFIVLNKGKAIFRFSATSALYMLTPFNPLRKIAIKILVHSLFSMLIMCTILTNCVFMTMSNPPDWTKNVEYTFTGIYTFESLIKILARGFCLEDFTFLRDPWNWLDFTVITFAYVTEFVDLGNVSALRTFRVLRALKTISVIPGLKTIVGALIQSVKKLSDVMILTVFCLSVFALIGLQLFMGNLRNKCLQWPPDNSTFETTVITYFNSSIGENGTFINTTMTIFNWDEYIEDENHFYFLEGQNDALLCGNSSDAGQCPEGYICVKAGRNPNYGYTSFDTFSWAFLSLFRLMTQDFWENLYQLTLRAAGKTYMIFFVLVIFLGSFYLINLILAVVAMAYEEQNQATMEEAEQKEAEFQQMLEQLKKQQEEAQAAAAAAAADSRDYSGVGGIGGFSESSSEASKLSSKSAKERRNRRKKKKQKEQAEGEKDEEEFRKSESEDSIKRKGFRFSIEGNRLTYEKRFSSPHQSLLSIRGSLFSPRRNSRTSLFSFRGRAKDVGSENDFADDEHSTFEDNESRRDSLFVPHRHGERRNSNISQASRSSRTVPPLPVNGKMHSTVDCNGVVSLVGGPPALTSPTGQLLPEGTTTETDLRKRRSSSYQVPMDYLTDPSARQRAMSIASMLTNTMEELEESRQKCPPCWYKFANTCLIWDCCTPWLKVKHIVNLIVMDPFVDLAITICIVLNTLFMAMEHYPMTEQFSGVLSVGNLVFTGIFTAEMFLKIIAMDPYYYFQEGWNIFDGFIVSLSLMELGLANVEGLSVLRSFRLLRVFKLAKSWPTLNMLIKIIGNSVGALGNLTLVLAIIVFIFAVVGMQLFGKSYKECVCKISSDCELPRWHMHDFFHSFLIVFRVLCGEWIETMWDCMEVAGQTMCLTVFMMVMVIGNLVVLNLFLALLLSSFSSDNLAATDDDNEMNNLQIAVARIQKGIDFVKRKVREFIQKAFVRKQKVLDEIKPLEDLNNKKDSCISNHTIVEIGKNLAYLKEGNGTTSGIGSSVEKYVVDESDYMSFINNPSLTVTVPIAVGESDFENLNTEEFSSESDLEESKEKLNASSSSEGSTVDIGLPPEGEQPEVEPEESLEPEACFTEGCVRRFKCCQVSVEDGKGKIWWNLRKTCYKIVEHNWFETFIVFMILLSSGALAFEDIYIEQRKTIKTMLEYADKVFTYIFILEMLLKWVAYGFQTYFTNAWCWLDFLIVDVSLVSLTANALGYSELGAIKSLRTLRALRPLRALSRFEGMRVVVNALLGAIPSIMNVLLVCLIFWLIFSIMGVNLFAGKFYYCVNTTTDERFDISQINNYSQCEELIKNNETARWKNVKVNFDNVGLGYLSLLQVATFKGWMDIMYAAVDSRNVLDQPKYEDNLYMYLYFVIFIIFGSFFTLNLFIGVIIDNFNQQKKKFGGQDIFMTEEQKKYYNAMKKLGSKKPQKPIPRPANKFQGMVFDFVTKQAFDISIMILICLNMVTMMVETDDQSEDMENILYWINLVFIVLFTGEFVLKLISLRHYYFTIGWNIFDFVVVILSIVGMFLAEMIEKYFVSPTLFRVIRLARIGRILRLIKGAKGIRTLLFALMMSLPALFNIGLLLFLVMFIYAIFGMSNFAYVKREVGIDDMFNFETFGNSMICLFQITTSAGWDGLLAPILNSGEPDCDPHKDHPGSSVKGDCGNPSVGIFFFVSYIIISFLVVVNMYIAVILENFSVATEESAEPLSEDDFEMFYEVWEKFDPDATQFIEFSKLSDFAASLDPPLLIAKPNKVQLIAMDLPMVSGDRIHCLDILFAFTKRVLGESGEMDALRIQMEDRFMAANPSKVSYEPITTTLKRKQEEVSAVVIQRAFRRHLLRQKVKKVSCIFNQDKGKDEDDLPMKEDMIMDKLNENSTPEKTDMTPSTTSPPSYDSVTKPDKDKYEKDKSEKEDKGKDSRESKK

SEQ ID NO: 55 - protein, 1867 aa, Ophiophagus hannah
MEKREASSFSLRLGCTDASKEEQGKFKAMLDYPAELRARAKSNFNVQDEKMAQTLLVPPGPDSFRFFTRESLAAIEKRCTEEKAKRPKQEHTDNDDESGPKPNSDLEAGKTLPFIYGDIPPGMVSEPLEDLDPYYSNKKTFIVLNRGKAIFRFSATSALYILTPFNPLRKIAIKILGVTPLNIWEQLFLKFYLLLNIKSVSKLRSVWNSTFFNFHLPASRYTFTGIYTFESLIKILARGFCLEGFTFLRDPWNWLDFSVILMAYVTEFVNLGNVSALRTFRVLRALKTISVIPGLKTIVGALIQSVKKLSDVMILTVFCLSVFALIGLQLFMGNLRHKCLLWPLDNATFEGNITSHFNSTEGENDTFVNMTVTTFNWEEYIEDESHFYVLEGQRDALLCGNSSDAGQCPEGYVCIKAGRNPNYGYTSFDTFSWAFLSLFRLMTQDFWENLYQLTLRAAGKTYMIFFVLVIFLGSFYLINLILAVVAMAYEEQNQATMEEAEQKEAEFQQMLEQLKKQQEEAQITIREATHLLITPNNNWFGLCSVLPPLQSLLSFRGSLFSPRRNSRTSIFSFRGRAKDIGSENDFADDEHSTLEDNESRRDSLFVPNRQTSERRNSTTSQMSLSSKMVPVLPANGKMHSTVDCNGVVSLMGGPPALPSPTGQFLPEGTTTETEIRKRRLSSYQISMELMEESAARQRAMSIASILTNTMEELEESRQKCPPCWYRFANVFLIWDCWSPWLKVKHIVNLIVMDPFVDLAITICIVLNTLFMAMEHYPMTSDFYQVLSVGNLVFTGIFTAEMILKIIAMDPYYYFQEGWNIFDGIIVSLSLMELGLANVEGLSVLRSFRLLRVFKLAKSWPTLNMLIKIIGNSVGALGNLTLVLAIIVFIFAVVGMQLFGKSYKECVCKIAEDCELPRWHMNDFFHSFLIVFRVLCGEWIETMWDCMEVAGQTMCLIVFMLVMVIGNLVVLNLFLALLLSSFSSDNLAATDDDNETNNLQIAVARIQKGIDYIKKKLGEIVQKSTVRKQKAIDDIKVFEELNHKKDVYISNHTMVEITKDVNYLRDGNGTTSGLGTGSSVEKYIIDENDYMSFINNPGLTVTVPIAVGESDFENINTEEFSSESDLEGSKEKINATSSSEGSTVDVALPGEGEQAEIEPEEALEPEACFTEGCIQKFPCCQVSIEDGKGKIWWNFRKTCYSIVEHNWFETFIVFMILLSSGALAFEDIYVEQRKTIKTMLEYADKVFTYIFILEMLLKWVAYGFQIYFTNAWCWLDFLIVDVSLVSLIANALGYSELGAIKSLRTLRALRPLRALSRFEGMRVVVNALIGAIPSIMNVLLVCLIFWLIFSIMGVNLFAGKFYHCVNTTTGEMFNISDVNNKTECDELIHNNQQARWKNVKVNFDNVGAGYLALLQVATFKGWMDIMYAAVDSRDVEEQPYYEDNLYMYLYFVIFIIFGSFFTLNLFIGVIIDNFNQQKKKIRQDIFMTEEQKKYYNAMKKLGSKKPQKPIPRPGNKFQGLVFDFVTKQAFDISIMILICLNMVTMMVETDDQSKEMEIILSRINLVFIILFTGECILKLISLRHYYFTIGWNIFDFVVVILSIVGMFLAEIIEKYFVSPTLFRVIRLARIGRILRLIKGAKGIRTLLFALMMSLPALFNIGLLLFLVMFIYAIFGMSNFAYVKREVGIDDLFNFETFGNSMLCLFQITTSAGWDGLLAPILNSGPPDCDPEIDHPGSSVKGDCGNPSVGIFFFVSYIIISFLVVVNMYIAVILENFSRAFRRFLLKQKVKKVTSMYNKEKCRDGEILPIKDVTSDRFNGNSSPEKTDESSSTTSPPSYDSVTKPNKEKYEKGKTDRDFKGKDIKISKK

SEQ ID NO: 56 - protein, 2019 aa, Chelonia mydas
MAQSVLVPPGPDSFHYFTRESLAAIEQRIAEEKAKKSKQERKDDDDENGPKPNSDLEAGKTLPFIYGDIPPGMVSEPLEDLDPYYINKKTFIVLNRGKAIFRFSATSAVYMLTPFNPLRKIAIKILVHSLFSMLIMCTILTNCVFMTMSNPPEWTKNVEYTFTGIYTFESLVKILARGFCLEDFTFLRDPWNWLDFTVITFAYVTEFVDLGNVSALRTFRVLRALKTISVIPGLKTIVGALIQSVKKLSDVMILTVFCLSVFALIGLQLFMGNLRHKCLQWPPDNSTLEINVISYFNSTIGENGSFVNTTVSTFNWEEYIEDRSHFYFLEGQNDALLCGNSSDAGQCPEGYICVKAGRNPNYGYTSFDTFSWAFLSLFRLMTQDFWENLYQLTLRAAGKTYMIFFVLVIFLGSFYLINLILAVVAMAYEEQNQATMEEAEQKEAEFQQMLEQLKKQQEEAQAAAAAAVAADSREFSGVGGVGGFSESSSEASKLSSKSAKERRNRRKKRKQKEQSEGEEKDEEDFHKSESEDSMRRKGFRFSIEGNRLTYEKRFSSPHQSLLSIRGSLFSPRRSSRTSLFSFRGRAKDVGSENDFADDEHSTFEDNESRRGSLFVPHRHGERRNSNISQASRSSRMVPALPANGKMHSTVDCNGVVSLVGGPPALTSPTGQLLPEVIIASKATQENGTTTETELRKRRTSSYHVSMDFLSEPSARQRAMSIASILTNTMEELEESRQKCPPCWYKFANTCLIWDCCTPWLRVKHIVNLIVMDPFVDLAITICIVLNTLFMAMEHYPMTEQFSHVLSVGNLVFTGIFTAEMFLKIVAMDPYYYFQEGWNIFDGFIVSLSLMELGLANVEGLSVLRSFRLLRVFKLAKSWPTLNMLIKIIGNSVGALGNLTLVLAIIVFIFAVVGMQLFGKSYKECVCKISNDCELPRWHMHDFFHSFLIVFRVLCGEWIETMWDCMEVAGQAMCLIVFMMVMVIGNLVVLNLFLALLLSSFSSDNLAATDDDNEMNNLQIAVARIQKGIDYVKRKAREFIQKAFVRKQKALDEIKPLEDLNNKKDSCISNHTVIEIGKDLNYLKDGNGTTSGVGSSVEKYVVDESDYMSFINNPSLTVTVPIAVGESDFENLNTEEFSSESDLEESKEKLNASSSSEGSTVDIGLPQEGEQPEIEPEEALEPEACFTEGCVRKFKCCQVSTEDGKGKIWWNLRKTCYKIVEHNWFETFIVFMILLSSGALAFEDIYIEQRKTIKTMLEYADKVFTYIFILEMLLKWVAYGFQTYFTNAWCWLDFLIVDVSLVSLTANALGYSELGAIKSLRTLRALRPLRALSRFEGMRVVVNALLGAIPSIMNVLLVCLIFWLIFSIMGVNLFAGKFYYCVNTTNDERFDISQINNYSQCEDLINNNETARWKNVKVNFDNVGLGYLSLLQVATFKGWMDIMYAAVDSRKVLDQPKYEDNLYMYLYFVIFIIFGSFFTLNLFIGVIIDNFNQQKKKFGGQDIFMTEEQKKYYNAMKKLGSKKPQKPIPRPANKFQGMVFDFVTKQVFDISIMILICLNMVTMMVETDNQSDEMQDNLWWINLVFIVLFTGECILKLISLRYYYFTIGWNIFDFVVVILSIVGMFLADLIEKYFVSPTLFRVIRLARIGRILRLIKGAKGIRTLLFALMMSLPALFNIGLLLFLVMFIYAIFGMSNFAYVKREVGIDDMFNFETFGNSMICLFQITTSAGWDGLLAPILNSGEPDCDPYKDHPGSSVKGDCGNPSVGIFFFVSYIIISFLVVVNMYIAVILENFSVATEESAEPLSEDDFEMFYEVWEKFDPDATQFIEFSKLSDFAASLDPPLLIAKPNKVQLIAMDLPMVSGDRIHCLDILFAFTKRVLGESGEMDTLRIQMEDRFMAANPSKVSYEPITTTLKRKQEEVSAVIIQRAFRRYLLKQKIKKVSCMFNQDKDKDEDDLPIKEDMIIDKLNENSTPEKTDMTPSTTSPPSYDSVTKPDKEKYEKDKSEKEDKGKDVRESKK

SEQ ID NO: 57 - DNA, 33 bp, Artificial Sequence
  oligonucleotide
tcgtcggcagcgtcagatgtgtataagagacag

SEQ ID NO: 58 - DNA, 34 bp, Artificial Sequence
  oligonucleotide
gtctcgtgggctcggagatgtgtataagagacag

What is claimed is:

1. A genetically modified rodent whose genome comprises:
a nucleic acid molecule encoding a human NaV1.2 protein, wherein the nucleic acid molecule
(i) comprises the ATG start codon to the stop codon of a human Scn2a gene,
(ii) is at an endogenous rodent Scn9a locus,
(iii) replaces a genomic fragment of the endogenous rodent Scn9a gene, and
(iv) is operably linked to an endogenous rodent Scn9a promoter at the endogenous rodent Scn9a locus,
wherein the genetically modified rodent expresses the human NaV1.2 protein and is incapable of expressing an endogenous rodent NaV1.7 protein, and
wherein the rodent is a mouse and produces antibodies against a human NaV1.7 protein when immunized with a human NaV1.7 immunogen.

2. The genetically modified rodent of claim 1, wherein the human NaV1.2 protein comprises an amino acid sequence having at least 95% identity with SEQ ID NO: 4.

3. The genetically modified rodent of claim 1, wherein the nucleic acid molecule is operably linked to the 5' UTR of the endogenous rodent Scn9a gene.

4. The genetically modified rodent of claim 1, wherein the nucleic acid molecule is operably linked to the 3' UTR of the human Scn2a gene.

5. The genetically modified rodent of claim 1, wherein the genomic fragment encodes the endogenous rodent NaV1.7 protein.

6. The genetically modified rodent of claim 1, wherein the nucleic acid molecule encoding the human NaV1.2 protein is a genomic fragment of a human Scn2a gene.

7. The genetically modified rodent of claim 1, wherein the nucleic acid molecule encoding the human NaV1.2 protein is a cDNA.

8. The genetically modified rodent of claim 1, wherein the rodent is heterozygous with respect to the nucleic acid molecule encoding the human NaV1.2 protein.

9. The genetically modified rodent claim 1, wherein the rodent is homozygous with respect to the nucleic acid molecule encoding the human NaV1.2 protein.

10. The genetically modified rodent of claim 1, further comprising:
a humanized immunoglobulin heavy chain locus comprising one or more human $V_H$ gene segments, one or more human $D_H$ gene segments, and one or more human $J_H$ gene segments,
wherein the one or more human $V_H$ gene segments, one or more human $D_H$ gene segments, and one or more human $J_H$ gene segments are operably linked to one or more rodent immunoglobulin heavy chain constant region genes,
wherein the genetically modified rodent is capable of producing antibodies comprising a human heavy chain variable domain and a rodent heavy chain constant domain in response to antigenic stimulation.

11. The genetically modified rodent of claim 1, further comprising:
a humanized immunoglobulin light chain locus comprising one or more human $V_L$ gene segments and one or more human $J_L$ gene segments,
wherein the one or more human $V_L$ gene segments and one or more human $J_L$ gene segments are operably linked to one or more rodent light chain constant region genes,
wherein the genetically modified rodent is capable of producing antibodies comprising a human light chain variable domain and a rodent light chain constant domain in response to antigenic stimulation.

12. The genetically modified rodent of claim 1, further comprising:
a humanized immunoglobulin light chain locus comprising one or more human $V_L$ gene segments and one or more human $J_L$ gene segments,
wherein the one or more human $V_L$ gene segments and one or more human $J_L$ gene segments are operably linked to one or more human light chain constant region genes,
wherein the genetically modified rodent is capable of producing antibodies comprising a human light chain variable domain and a human light chain constant domain in response to antigenic stimulation.

13. The genetically modified rodent of claim 11, wherein the one or more human $V_L$ and one or more human $J_L$ gene segments are one or more human Vλ gene segments and one or more human Jλ gene segments.

14. The genetically modified rodent of claim 11, wherein the one or more human $V_L$ and one or more human $J_L$ gene segments are one or more human Vκ gene segments and one or more human Jκ gene segments.

15. The genetically modified rodent of claim 11, wherein the one or more rodent light chain constant region genes are one or more rodent Cλ genes.

16. The genetically modified rodent of claim 11, wherein the one or more rodent light chain constant region genes are one or more rodent Cκ genes.

17. The genetically modified rodent of claim 1, wherein the rodent comprises nucleotide encoding a rodent ADAM6 protein or functional fragment or ortholog thereof.

18. The genetically modified rodent of claim 1, wherein the rodent comprises an exogenous TdT gene.

19. A method of making a genetically modified rodent, comprising:
modifying a rodent genome such that the modified genome comprises a nucleic acid molecule encoding a human NaV1.2 protein, wherein the nucleic acid molecule (i) comprises the ATG start codon to the stop codon of a human Scn2a gene,
(ii) is at an endogenous rodent Scn9a locus,
(iii) replaces a genomic fragment of the endogenous rodent Scn9a gene, and
(iv) is operably linked to an endogenous rodent Scn9a promoter at the endogenous rodent Scn9a locus; and
generating a rodent comprising the modified genome,
wherein the rodent generated expresses the human NaV1.2 protein and is incapable of expressing an endogenous rodent NaV1.7 protein, and
wherein the rodent is a mouse and produces antibodies against a human NaV1.7 protein when immunized with a human NaV1.7 immunogen.

20. A method of making a genetically modified rodent, comprising:
(i) introducing a nucleic acid molecule into a rodent embryonic stem (ES) cell such that the nucleic acid molecule integrates into an endogenous rodent Scn9a locus, wherein the nucleic acid molecule encodes a human NaV1.2 protein and comprises the ATG start codon to the stop codon of a human Scn2a gene;
(ii) obtaining a rodent ES cell comprising a modified genome, wherein the nucleic acid molecule has integrated into an endogenous rodent Scn9a locus, has replaced a genomic fragment of the endogenous rodent Scn9a gene, and is operably linked to an endogenous rodent Scn9a promoter at the endogenous rodent Scn9a locus; and
(iii) generating a rodent using the rodent ES cell comprising the modified genome, wherein the rodent generated expresses the human NaV1.2 protein, is incapable of expressing an endogenous rodent NaV1.7 protein, and produces antibodies against a human NaV1.7 protein when immunized with a human NaV1.7 immunogen, and wherein the rodent is a mouse.

21. An isolated rodent cell or tissue, whose genome comprises:
a nucleic acid molecule encoding a human NaV1.2 protein, wherein the nucleic acid molecule
(i) comprises the ATG start codon to the stop codon of a human Scn2a gene,
(ii) is at an endogenous rodent Scn9a locus,
(iii) replaces a genomic fragment of the endogenous rodent Scn9a gene, and
(iv) is operably linked to an endogenous rodent Scn9a promoter at the endogenous rodent Scn9a locus,
wherein the isolated rodent cell or tissue is incapable of expressing an endogenous rodent NaV1.7 protein, and
wherein the isolated rodent cell or tissue is a mouse cell or mouse tissue.

22. The isolated rodent cell or tissue of claim 21, wherein the rodent cell is a rodent ES cell.

23. An immortal cell line established from the isolated cell of claim 21.

24. A rodent embryo comprising the rodent ES cell of claim 22.

25. A method of producing an anti-NaV1.7 antibody, comprising
immunizing the genetically modified rodent of claim 1 with a human NaV1.7 immunogen so as to generate an immunized rodent, and
making the anti-human NaV1.7 antibody using the immunized rodent.

26. A hybridoma that produces an anti-human NaV1.7 antibody, wherein the hybridoma is made from a B cell isolated from the rodent of claim 1, wherein the rodent has been immunized with a human NaV1.7 immunogen.

* * * * *